US007501485B2

(12) United States Patent  
Cowsar

(10) Patent No.: US 7,501,485 B2
(45) Date of Patent: Mar. 10, 2009

(54) BIOACTIVE KERATIN PEPTIDES

(75) Inventor: Donald R. Cowsar, Savannah, GA (US)

(73) Assignee: Keraplast Technologies, Ltd., San Antonio, TX (US)

( * ) Notice: Subject to any disclaimer, the term of this patent is extended or adjusted under 35 U.S.C. 154(b) by 250 days.

(21) Appl. No.: 10/352,786

(22) Filed: Jan. 28, 2003

(65) Prior Publication Data

US 2003/0228353 A1 Dec. 11, 2003

Related U.S. Application Data

(60) Provisional application No. 60/352,396, filed on Jan. 28, 2002.

(51) Int. Cl.
*C07K 14/435* (2006.01)
(52) U.S. Cl. .......................... 530/324; 514/12
(58) Field of Classification Search ................ 530/324, 530/325–330; 514/12–18, 2
See application file for complete search history.

(56) References Cited

U.S. PATENT DOCUMENTS

| 922,692 | A | 5/1909 | Goldsmith |
| 926,999 | A | 7/1909 | Neuberg |
| 960,914 | A | 6/1910 | Heinemann |
| 1,214,299 | A | 1/1917 | Grosvenor et al. |
| 2,434,688 | A | 1/1948 | Evans .......................... 18/47.5 |
| 2,445,028 | A | 7/1948 | Jones et al. ................. 106/155 |
| 2,517,572 | A | 8/1950 | Jones et al. ................. 106/155 |
| 2,814,851 | A | 12/1957 | Hervey ........................... 28/82 |
| 3,033,755 | A | 5/1962 | Jacobi et al. ................... 167/90 |
| 3,642,498 | A | 2/1972 | Anker .......................... 99/166 |
| 3,655,416 | A | 4/1972 | Vinson et al. ............... 106/155 |
| 4,178,361 | A | 12/1979 | Cohen et al. .................. 424/22 |
| 4,357,274 | A | 11/1982 | Werner ..................... 260/123.7 |
| 4,423,032 | A | 12/1983 | Abe et al. ...................... 424/70 |
| 4,495,173 | A | 1/1985 | Matsunaga et al. ............ 424/70 |
| 4,570,629 | A | 2/1986 | Widra ......................... 128/156 |
| 4,751,074 | A | 6/1988 | Matsunaga et al. ............ 424/70 |
| 4,816,441 | A * | 3/1989 | Zeuthen et al. ............... 514/12 |
| 4,895,722 | A | 1/1990 | Abe et al. ...................... 424/71 |
| 4,959,213 | A | 9/1990 | Brod et al. .................... 514/21 |
| 5,047,249 | A | 9/1991 | Rothman et al. ............. 424/543 |
| 5,320,796 | A | 6/1994 | Harashima et al. .......... 264/349 |
| 5,634,945 | A | 6/1997 | Pernia et al. .................. 623/11 |
| 5,679,819 | A | 10/1997 | Jones et al. .................. 556/418 |
| 5,712,252 | A | 1/1998 | Smith ............................ 514/21 |
| 5,763,583 | A | 6/1998 | Arai et al. ................... 530/353 |
| 6,037,135 | A * | 3/2000 | Kubo et al. ................. 435/7.24 |
| 6,110,889 | A * | 8/2000 | Miller et al. .................. 514/17 |
| 6,586,570 | B1 * | 7/2003 | Frudakis et al. ............. 530/350 |

FOREIGN PATENT DOCUMENTS

| EP | 0468797 B1 | 12/1995 |
| GB | 531446 | 1/1941 |
| JP | S55-187190 | 12/1980 |
| JP | SHO 54-124043 | 2/1982 |
| JP | SHO 60-220068 | 11/1985 |
| JP | 1988-202582 | 8/1988 |
| JP | 3-223207 | 10/1991 |
| JP | 1992-174659 | 5/1992 |
| JP | HEI 4-189833 | 7/1992 |
| JP | 1993285374 A | 11/1993 |
| JP | 1993285375 A | 11/1993 |
| JP | 1994100600 A | 4/1994 |
| JP | 1994116300 A | 4/1994 |
| JP | 8-157342 | 6/1996 |
| JP | 1998291999 A | 11/1998 |
| JP | 1998337466 A | 12/1998 |
| JP | 2001-114647 | 4/2001 |
| WO | WO 91/02538 | 3/1991 |
| WO | WO 98/08550 | 3/1998 |
| WO | 99/54345 | * 10/1999 |
| WO | WO 03/011894 A1 | 2/2003 |
| WO | WO 03/018673 A1 | 3/2003 |

OTHER PUBLICATIONS

Bayer (EMBO Journal 3(8), 1925-30, 1984).*
Buchta (International Journal of Peptide & Protein Research 28(3), 289-97, 1986).*
Aoki, "Isolation and characterization of mouse high-glycine/tyrosine proteins," The Journal of Biological Chemistry, Nov. 28, 1997, 30512-30518, 272:48, The American Society for Biochemistry and Molecular Biology, Inc., USA.
Thomas et al., "Isolation of microfibrillar proteins of wool in disulfide form," Melliand Textiberichte, 65(3):20809, 1984.
van de Löcht, "Reconstitution of microfibrils from wool and filaments from epidermis proteins," Melliand Textiberichte, 10:780-6, 1987.
Yoshioka et al., "Cosmetic base," unexamined Japanese Patent Application No. 3-223207, Oct. 2, 1991.
Yoshioka et al., "Water-soluble hair dressing agent," unexamined Japanese Patent Application No. 8-157342, Jun. 18, 1996.
Hyuku et al., "Novel amino acid silicone polymer, production thereof, cosmetic particles surface treated with the polymer, and cosmetic containing said particles," unexamined Japanese Patent Application No. 2001-114647, Apr. 24, 2001.
Yamauchi, "The development of keratin: characteristics of polymer films," *Fragrance J*, 21(5), 62-7, 1993.
Sauk et al, "Reconstitution of cytokeratin filaments in vitro: further evidence for the role of nonhelical peptides in filament assembly," *The Journal of Cell Biology*, 99, 1590-1597, Nov. 1984.
Weber et al., "The structural relation between intermediate filament proteins in living cells and the α-keratins of sheep wool," *The EMBO Journal*, 1:10, 1155-1160, 1982.
Hanukoglu et al., "The cDNA sequence of a human epidermal keratin: divergence of sequence but conservation of structure among intermediate filament proteins," *Cell*, 31, 243-252, Nov. 1982.
Fraser et al., "Intermediate filaments in α-keratins," *Proc. Natl. Acad. Sci. USA*, 83, 1179-1183, Mar. 1986.

(Continued)

*Primary Examiner*—David Lukton
(74) *Attorney, Agent, or Firm*—Vinson & Elkins LLP

(57) ABSTRACT

Compositions containing biologically active peptides are disclosed. Active peptides are isolated fragments derived from human hair or sheep wool keratin proteins. Compositions may be prepared for pharmaceutical or topical administration or for use in cosmetic preparations.

38 Claims, No Drawings

OTHER PUBLICATIONS

Jones, "Studies on microfibrils from α-keratin," *Biochimica et Biophysica Acta*, 446, 515-524, Received Apr. 5, 1976.

Zackroff, et al., "In vitro assembly of intermediate filaments from baby hamster kidney (BHK-21) cells," *Proc. Natl. Acad. Sci. USA*, 76:12, 6226-6230, Dec. 1979.

Mack, et al., "Solid-state NMR studies of the dynamics and structure of mouse keratin intermediate filaments," *Biochemistry*, 27, 5418-5426, 1988.

Skerrow, et al., "Epidermal α-keratin is neutral-buffer-soluble and forms intermediate philam . . . physiological conditions in vitro," *Biochimica et Biophysica Acta*, 915, 125-131, 1987.

Kvedar, et al., "Cytokeratins of the bovine hoof: classification and studies on expression," *Biochimica et Biophysica Acta*, 884, 462-473, 1986.

Moll, et al., "The catalog of human cytokeratins: patterns of expression in normal epithelia, tumors and cultured cells," *Cell*, 31, Nov. 11-24, 1982.

Iwatsuki, et al., "Comparative studies on naturally occurring antikeratin antibodies in human sera," *The Journal of Investigative Dermatology*, 87:2, 179-184, Aug. 1986.

Lambré, et al., "An enzyme immunoassay for auto-antibodies to keratin in normal human serum and in pleural fluids from patients with various malignant or non-malignant lung diseases," *J. Clin. Lab. Immunol.*, 20, 171-176, 1986.

Stokes, et al., "Passage of water and electrolytes through natural and artificial keratin membranes," *Desalination*, 42, 321-328, 1982.

Dedeurwaerder, et al., "Selective extraction of a protein fraction from wool keratin," *Nature*, 265, 48-49 and 274-276, Jan. 20, 1977.

Brunner, et al., "Fractionation of tyrosine-rich proteins from oxidized wool by ion-exchange chromatography and preparative electrophoresis," *Eur. J. Biochem.*, 32, 350-355, 1973.

Mies, et al., "Chromatographic and electrophoretic investigations of the properties of unprotected low-sulphur wool kerateins," *Journal of Chromatography*, 405, 365-370, 1987.

Katsuumi, et al., "Two-dimensional electrophoretic analysis of human hair keratins, especially hair matrix proteins," *Arch. Dermatol Res.*, 281, 495-501, 1989.

Horn, et al., "Relative molecular masses of reduced wool keratin polypeptides," *Biochem Soc Trans*, 14, 333-334, 1986.

Harrap, et al., "Species differences in the proteins of feathers," *Comp. Biochem. Physiol.*, 20, 449-460, 1967.

Harrap, et al., "Soluble derivatives of feather keratin," *Biochem. J.*, 92, 8-18, 1964.

Yoshimizu, et al., "$^{13}$C CP/MAS NMR study of the conformation of stretched or heated low-sulfur keratin protein films," *Macromolecules*, 24, 862-866, 1991.

Schaller, et al., "Membranes prepared from keratin-polyacrylonitrile graft copolymers," *Journal of Applied Polymer Science*, 25, 783-794, 1980.

Weiss, et al., "The use of monoclonal antibody to keratin in human epidermal disease: alterations in immunohistochemical staining pattern," *The Journal of Investigative Dermatology*, 81, 224-230, 1983.

Starger, et al., "Biochemical and immunological analysis of rapidly purified 10-nm filaments from baby hamster kidney (BHK-21) cells," *J. Cell Biology*, 78, 93-109, 1978.

Valherie, "Chemical modifications of keratins. Application to the preparation of biomaterials and study of their physical, physiocochemical and biological properties," Ph.D. Thesis presented to the National Institute of Applied Sciences of Lyon, 1992.

Dale, "Keratin and other coatings for pills," *Pharm. J.*, 129, 494-495, 1932, Abstract.

Schrooyen, et al., "Biodegradable films from selectively modified feather keratin dispersions," *Polymer Preprints (American Chemical Society, Division of Polmer Chemistry)*, 39(2), 160, 1998, Abstract.

Schrooyen, et al., "Polymer films from chicken feather keratin," Book of Abstracts, 216th ACS National Meeting, Boston, Aug. 23-27, 1998, Abstract.

Gillespie, et al., "Amino acid composition of a sulphur-rich protein from wool," *Biochimica et Biophysica Acta*, 39, 538-539, 1960.

Gough, et al., "Amino acid sequences of α-helical segments from S-carboxymethylkerateine-A. Complete sequence of a type-I segment," *Biochem. J.*, 173, 373-385, 1978.

Elleman, et al., "Amino acid sequences of α-helical segments from S-carboxymethylkerateine-A. Statistical analysis," *Biochem. J.*, 173, 387-391, 1978.

Hogg, et al., "Amino acid sequences of α-helical segments from S-carboxymethylkerateine-A. Tryptic and chymotryptic peptides from a type-II segment," *Biochem. J.*, 173, 353-363, 1978.

Earland, et al., "Studies on the structure of keratin. II. The amino acid content of fractions isolated from oxidized wool," *Biochimica et Biophysica Acta*, 22, 405-411, 1956.

Crewther, et al., "Amino acid sequences of α-helical segments from S-carboxymethylkerateine-A. Complete sequence of a type-II segment," *Biochem. J.*, 173, 365-371, 1978.

Fraser, et al., "Microscopic observations of the alkaline-thioglycollate extraction of wool," *Biochimica et Biophysica Acta*, 22, 484-485, 1953.

Gillespie, et al., "Preparation of an electrophoretically homogeneous keratin derivative from wool," *Biochimica et Biophysica Acta*, 12, 481-483, 1953.

Blagrove, et al., "The electrophoresis of the high-tyrosine proteins of keratins on cellulose acetate strips," *Comp. Biochem. Physiol.*, 50B, 571-572, 1975.

Frenkel, et al., "The isolation and properties of a tyrosine-rich protein from wool: component 0.62." *Eur. J. Biochem.*, 34, 112-119, 1973.

Marshall, et al., "Successful isolelectric focusing of wool low-sulphur proteins," *Journal of Chromatography*, 172, 351-356, 1979.

Marshall, "Characterization of the proteins of human hair and nail by electrophoresis," *The Journal of Investigative Dermatology*, 80:6, 519-524, 1983.

Lindley, et al., "Occurrence of the cys-cys sequence in keratins," *J. Mol. Biol.*, 30, 63-67, 1967.

Marshall, "Genetic variation in the proteins of human nail," *The Journal of Investigative Dermatology*, 75:3, 264-269, 1980.

Goddard, et al., "A study on keratin," *J. Bio. Chem.*, 106, 605-614, 1934.

Dowling, et al., "Isolation of components from the low-sulphur proteins of wool by fractional precipitation," *Preparative Biochemistry*, 4(3), 203-226, 1974.

Crewther, et al., "Reduction of S-carboxymethylcysteine and methionine with sodium in liquid ammonia," *Biochimica et Biophysica Acta*, 194, 606-609, 1969.

Gillespie, "The isolation from wool of a readily extractable protein of low sulphur content," *Biochimica et Biophysica Acta*, 27, 225-226, 1958.

Lindley, et al., "The reactivity of the disulphide bonds of wool," *Biochem. J.*, 139, 515-523, 1974.

Mitsui, et al., "Genes for a range of growth factors and cyclin-dependent kinase inhibitors are expressed by isolated human hair follicles," *British Journal of Dermatology*, 137(5), 693-698, 1997, Abstract.

Schörnig, et al., "Synthesis of nerve growth factor mRNA in cultures of developing mouse whisker pad, a peripheral target tissue of sensory trigeminal neurons." *The Journal of Cell Biology*, 120:6, 1471-1479, 1993.

Filshie, et al., "The fine structure of α-keratin," *J. Mol. Biol.*, 3, 784-786, 1961.

Filshie, et al., "An electron microscope study of the fine structure of feather keratin," *The Journal of Cell Biology*, 13, 1-12, 1962.

Crewther, et al., "Low-sulfur proteins from α-keratins. Interrelationships between their amino acid compositions, α-helix contents, and the supercontraction of the parent keratin," *Biopolymers*, 4, 905-916. 1966.

Bhatnagar, et al., "The conformation of the high-sulphur proteins of wool. I. The preparation and properties of a water-soluble metakeratin," *Int. J. Protein Research I*, 199-212, 1969.

Crewther, et al., "The preparation and properties of a helix-rich fraction obtained by partial proteolysis of low sulfur S-carboxymethylkerateine from wool," *The Journal of Biological Chemistry*, 242:19, 4310-4319, 1967.

Parry, et al., "Structure of α-keratin: structural implication of the amino acid sequences of the type I and type II chain segments," *J. Mol. Biol.*, 113, 449-454, 1977.

Suzuki, et al, "X-ray diffraction and infrared studies of an α-helical fragment from α-keratin," *J. Mol. Biol.*, 73, 275-278, 1973.

Bhatnagar, et al., "The conformation of the high-sulphur proteins of wool. II. Difference spectra of kerateine-B," *Int. J. Protein Research I*, 213-219, 1969.

Steinert, et al., "In vitro studies on the synthesis of guinea pig hair keratin proteins," *Biochimica et Biophysica Acta*, 312, 403-412, 1973.

Rogers, "Some observations on the proteins of the inner root sheath cells of hair follicles," *Biochimica et Biophysica Acta*, 29, 33-42, 1958.

Tachibana, et al., "Fabrication of wool keratin sponge scaffolds for long-term cell cultivation," *Journal of Biotechnology*, 93, 165-170, 2002.

Gillespie, "Proteins rich in glycine and tyrosine from keratins," *Comp. Biochem. Physiol.*, 41B, 723-734, 1972.

Fraser, et al., "Tyrosine-rich proteins in keratins," *Comp. Biochem. Physiol.*, 44B, 943-947, 1973.

Bendit, et al., "Communications to the Editor. The probable role and location of high glycine-tyrosine proteins in the structure of keratins," *Biopolymers*, 17, 2743-2745, 1978.

Lindley, et al., "The preparation and properties of a group of proteins from the high-sulphur fraction of wool," *Biochem. J.*, 128, 859-867, 1972.

Gillespie, et al., "Evidence of homology in a high-sulphur protein fraction (SCMK-B2) of wool and hair α-keratins," *Biochem. J.*,110, 193-198, 1968.

Gillespie, et al., "A comparative study of high-sulphur proteins from α-keratins," *Comp. Biochem. Physiol.*, 15, 175-185, 1965.

Wormell, "Regenerated protein fibres from wool and casein," *The Journal of the Textile Institute*, 18, T219-T224, 1948.

Harding, et al., "Formation of the $_e$-(γ-glutamyl) lysine cross-link in hair proteins. Investigation of transamidases in hair follicles," *Biochemistry*, 11:15, 2858-2863, 1972.

Powell, et al., "Control of feather keratin synthesis by the availability of keratin mRNA," *Biochemical and Biophysical Research Communications*, 68:4, 1263-1271, 1976.

Strüssmann, et al., "Specific radiolabelling of keratin proteins by amidination,"*Journal of Chromatography*, 268, 306-310, 1983.

Lindley, et al., "Disulphide interchange reactions involving cyclocystine and their relevance to problems of α-keratin structure," *Biochem. J.*, 108, 701-703, 1968.

Damoglou, et al., "The hydrolysis by thermolysin of dipeptide derivatives that contain substituted cysteine," *Biochem. J.*, 123, 379-384, 1971.

Lennox, et al., "Photochemical degradation of keratins," *Photochemistry and Photobiology*, 9, 359-367, 1969.

Crewther, et al., "Preliminary Notes. The relation between the disulphide content of wool and the two-stage supercontraction of wool fibres in solutions of LiBr," *Biochimica et Biophysica Acta*, 46, 605-606. 1961.

Gillespie, et al., "A comparison of the proteins of normal and trichothiodystrophic human hair" *The Journal of Investigative Dermatology*, 80, 195-202, 1983.

Gillespie, et al., "Changes in the proteins of wool following treatment of sheep with epidermal growth factor," *The Journal of Investigative Dermatology*, 79:3, 197-200, 1982.

Gillespie, et al., "Changes in the matrix proteins of wool and mouse hair following the administration of depilatory compounds," *Aust. J. Biol. Sci.*, 33, 125-136, 1980.

Darskus, et al., "Breed and species differences in the hair proteins of four genera of caprini," *Aust. J. Biol. Sci.*, 24, 515-524, 1971.

Kemp, et al., "Differentiation of avian keratinocytes. Characterization and relationships of the keratin proteins of adult and embryonic feathers and scales," *Biochemistry*, 11:6, 969-975, 1972.

Gillespie, et al., "The diversity of keratins," *Comp. Biochem. Physiol.*, 47B, 339-346, 1974.

Fraser, et al., "Wool structure and biosynthesis," *Nature*, 261, 650-654, 1976.

Stenn, et al., editors, "The molecular and structural biology of hair," *Annals of the New York Academy of Sciences*, vol. 642, Title Page - 31, 1991.

Reis, et al., "The utilization of abomasal supplements of proteins and amino acids by sheep with special reference to wool growth," *Aust. J. Biol. Sci.*, 25, 1057-1071, 1972.

Broad, et al., "The influence of sulphur-containing amino acids on the biosynthesis of high-sulphur wool proteins," *Aust. J. Biol. Sci.*, 23, 149-164, 1970.

Reis, "The influence of dietary protein and methionine on the sulphur content and growth rate of wool in milk-fed lambs," *Aust. J. Biol. Sci.*, 23, 193-200, 1970.

Downes, et al., "Metabolic fate of parenterally administered sulphur-containing amino acids in sheep and effects on growth and composition of wool," *Aust. J. Biol. Sci.*, 23, 1077-1088, 1970.

Reis, "The growth and composition of wool. IV. The differential response of growth and content of wool to the level of sulphur-containing amino acids given per abomasum," *Aust. J. Biol. Sci.*, 20, 809-825, 1967.

Reis, et al., "Effects of phenylalanine and analogues of methionine and phenylalanine on the composition of wool and mouse hair," *Aust. J. Biol. Sci.*, 38:2, 151-163.

Frenkel, et al., "Studies on the inhibition of synthesis of the tyrosine-rich proteins of wool," *Aust. J. Biol. Sci.*, 28, 331-338, 1975.

Frenkel, et al., "Factors influencing the biosynthesis of the tyrosine-rich proteins of wool," *Aust. J. Biol. Sci.*, 27, 31-38, 1974.

Reis, "The growth and composition of wool. III. Variations in the sulphur content of wool," *Aust. J. Biol. Sci.*, 18, 671-687, 1965.

Reis, et al., "The influence of abomasal and intravenous supplements of sulphur-containing amino acids on wool growth rate," *Aust. J. Biol. Sci.*, 26, 249-258, 1973.

Gillespie, et al., "A further study on the dietary-regulated biosynthesis of high-sulphur wool proteins," *Biochem. J.*, 112, 41-49, 1969.

Gillespie, et al., "The dietary-regulated biosynthesis of high-sulphur wool proteins," *Biochem. J.*, 98, 669-677, 1966.

Powell, et al., "Characterization of a gene encoding a cysteine-rich keratin associated protein synthesized late in rabbit hair follicle differentiation," *Differentiation*, 58, 227-232, 1995.

Powell, et al., "Cyclic hair-loss and regrowth in transgenic mice overexpressing an intermediate filament gene," *The EMBO Journal*, 9:5, 1485-1493, 1990.

Raphael, et al., "Protein and amino acid composition of hair from mice carrying the naked (N) gene," *Genet. Res. Camb.*, 44:1, 29-38, 1984.

Frenkel, et al., "The keratin BIIIB gene family: isolation of cDNA clones and structure of a gene and a related pseudogene," *Genomics*, 4, 182-191, 1989.

Dowling, et al., "The primary structure of component 8c-1, a subunit protein of intermediate filaments in wool keratin," *Biochem. J.*, 236, 695-703, 1986.

Dowling, et al., "Secondary structure of component 8c-1 of α-keratin," *Biochem. J.*, 236, 705-712, 1986.

Kuczek, et al., "Sheep wool (glycine + tyrosine)-rich keratin genes," *Eur. J. Biochem.*, 166, 79-85, 1987.

Sakabe, et al., "Differential thermal analysis of component proteins from wool," Sen-I Gakkaishi 39(12): T-517-T-522 (1982).

Edwards, "Chemical studies on powdered keratins," *The Journal of Biological Chemistry*, 154, 593-596, 1944.

* cited by examiner

BIOACTIVE KERATIN PEPTIDES

CROSS-REFERENCE TO RELATED APPLICATIONS

This application relies for priority on co-pending U.S. Provisional Application No. 60/352,396, filed Jan. 28, 2002, the disclosure of which is incorporated herein in its entirety by reference.

STATEMENT REGARDING FEDERALLY SPONSORED RESEARCH OR DEVELOPMENT

N/A

BACKGROUND OF THE INVENTION

Chronic wounds can be caused by a variety of events, including surgery, prolonged bedrest and traumatic injuries. Partial thickness wounds can include second degree burns, abrasions, and skin graft donor sites. Healing of these wounds can be problematic, especially in cases of diabetes mellitus or chronic immune disorders. Full thickness wounds have no skin remaining, and can be the result of trauma, diabetes (e.g., leg ulcers) and venous stasis disease, which can cause full thickness ulcers of the lower extremities. Full thickness wounds tend to heal very slowly or not at all. Proper wound care technique including the use of wound dressings is extremely important to successful chronic wound management. Chronic wounds affect an estimated four million people a year, resulting in health care costs in the billions of dollars. T. Phillips, O. Kehinde, and H. Green, "Treatment of Skin Ulcers with Cultivated Epidermal Allografts," J. Am. Acad. Dermatol, V. 21, pp. 191-199 (1989).

The wound-healing process involves a complex series of biological interactions at the cellular level which can be grouped into three phases: homeostasis and inflammation; granulation tissue formation and reepithelization; and remodeling. R. A. F. Clark, "Cutaneous Tissue Repair: Basic Biological Considerations," J. Am. Acad. Dermatol, Vol. 13, pp. 701-725 (1985). Keratinocytes (epidermal cells that manufacture and contain keratin) migrate from wound edges to cover the wound. Growth factors such as transforming growth factor-$\beta$ (TGF-$\beta$) play a critical role in stimulating the migration process. The migration occurs optimally under the cover of a moist layer. Keratins have also been found to be necessary for reepithelization. Specifically, keratin types K5 and K14 have been found in the lower, generating, epidermal cells, and types K1 and K10 have been found in the upper, differentiated cells. I. K. Cohen, R. F. Diegleman, and W. J. Lindblad, eds., Wound Healing: Biochemical and Clinical Aspects, W. W. Saunders Company, 1992. Keratin types K6 and K10 are believed to be present in healing wounds, but not in normal skin. Keratins are major structural proteins of all epithelial cell types and appear to play a major role in wound healing.

Although not ideal for chronic wounds, several wound dressings are currently on the market, including occlusive dressings, non-adherent dressings, absorbent dressings, and dressings in the form of sheets, foams, powders and gels. S. Thomas, Wound Management and Dressing, The Pharmaceutical Press, London, 1990.

Attempts have been made to provide improved dressings that would assist in the wound☐healing process using biological materials such as growth factors. These biologicals have proven very costly and, due to the lack of an appropriate delivery vehicle, have shown minimal clinical relevance in accelerating the chronic wound-healing process relative to their cost. In cases of severe full thickness wounds, autografts (skin grafts from the patient's body) are often used. Although the graft is non-antigenic, it must be harvested from a donor site on the patient's body, creating an additional wound. In addition, availability of autologous tissue may not be adequate. Allografts (skin grafts from donors other than the patient) are also used when donor sites are not an option. Allografts essentially provide a "wound dressing" that provides a moist, water-permeable layer, but are rejected by the patient, usually within two weeks, and do not become part of the new epidermis.

SUMMARY

The present disclosure arises from the surprising discovery that certain peptides derived from keratin proteins exhibit biological activity. The activity of these peptides has been demonstrated by their ability to stimulate growth of dermal fibroblasts comparable with known fibroblast growth factors. Compositions containing the peptides are thus useful in the treatment of conditions involving damaged, aged, or diseased epithelial tissue and skin. Because of the cytokine-like activity of the peptides, compositions containing these peptides are also contemplated to be useful in stimulation of tissue or cell growth in applications including, but not limited to tissue growth and repair including skin and bone tissue. The amino acid sequences of the active peptides indicate that the peptides are derived from a region of 39 amino acids that appears in various human hair and sheep wool keratin proteins. This conserved segment contains single amino acid changes in several locations in the consensus. The claimed compositions include peptides of from 4 to 39 amino acids in length that incorporate each of the sequence variations.

The present disclosure may be described therefore, in a preferred embodiment, as a composition that includes one or more biologically active peptides and in which the peptides are from about 4 to about 39 amino acids in length and occur as contiguous sequences in the peptides disclosed herein as SEQ ID NOs:1-32. The peptides may be made by any means known in the art, including isolation from natural sources, recombinant production or chemical synthesis. Natural sources would include keratin proteins that naturally occur in inter alia, human hair, animal hair, wool, fur, nails, hooves, horns, beaks, skin and feathers. Recombinantly produced peptides may also be expressed in a bacterial host cell or a eukaryotic host cell.

An alternative embodiment of the present disclosure is an isolated nucleic acid molecule that encodes any of the peptides disclosed herein and described in the previous paragraph, and more specifically, an isolated nucleic acid molecule that encodes any peptide of from about 4 to about 39 amino acids that occurs as a contiguous amino acid sequence in the peptides designated herein as SEQ ID NOs:1-32. Such peptides include all the peptides disclosed herein as SEQ ID NOS:1-6270, inclusively. The isolated nucleic acid sequences or molecules may be fragments of naturally occurring nucleic acid sequences that encode keratin proteins, for example, or they may be variations of such sequences that encode the disclosed peptides due to redundancies in the genetic code. Alternatively, the nucleic acid molecules may be chemically synthesized based on the desired amino acid sequences to be expressed. The isolated nucleic acid sequences or molecules are preferably contained in vectors, including expression vectors capable of directing expression of the peptides in an appropriate host cell. The host cell may preferably be a bacterial cell or a eukaryotic cell. Certain embodiments of the present disclosure are vectors containing the described nucleic acid segments and host cells that contain those vectors.

In certain embodiments of the disclosure, the peptides are contained in, or combined with pharmaceutically acceptable carriers. As used herein, "pharmaceutically acceptable carrier" includes any and all solvents, dispersion media, coatings, antibacterial and antifungal agents, isotonic and absorption delaying agents and the like. The use of such media and agents for pharmaceutically active substances is well known in the art. Except insofar as any conventional media or agent is incompatible with the peptide ingredients, its use in the therapeutic or cosmetic compositions is contemplated.

The pharmaceutical compositions are preferably formulated for administration to veterinary or human subjects, and may be optionally formulated for oral, topical or optical administration. Similarly, the claimed compositions may be formulated for implantation, coated on a surface to be implanted or contained within an implant. Additionally, in certain preferred embodiments, the compositions are formulated for application to wounds. In certain embodiments, the claimed compositions are formulated for application to burned, aged, wrinkled, scarred, or damaged skin, and are also useful in the relief of pain, burning, or itching. In certain embodiments, the peptide containing compositions of the present disclosure are formulated for the treatment of gastrointestinal, anal, vaginal, ear, eye, lung, nasal, oral or urogential epithelial tissue, including, but not limited to, for example, the treatment of Crohn's disease, skin grafts or ulcers, including diabetic ulcers.

The biological activity of the disclosed peptides may be any activity that is beneficial as a research tool for or for the benefit of a human or animal recipient of the formulations, including cell growth activation or inhibition, or cytokine-like activity. The cytokine-like activity is preferably cell differentiation, cell proliferation, cell adhesion, effect on cell morphology, cell migration, inflammatory response, angiogenesis, cell death or the like. The disclosed peptides may also be combined with other growth factors in order to enhance the healing activity of damaged skin, for example. In certain embodiments, then, a composition may contain any of the peptides derived from the peptides designated as SEQ ID NO:1-32 in combination with a growth factor such as epidermal growth factor (EGF), transforming growth factor-alpha (TGF-a), fibroblast growth factor (FGF), keratinocyte growth factor (KGF), platelet derived growth factor (PDGF) or a mixture of these in any combination.

An additional preferred embodiment of the present disclosure is compositions containing the described peptides in which the peptide or peptides are present in an amount effective to inhibit microbial growth. It has been observed by the present inventor that solutions containing the disclosed peptides may be kept "on the shelf" for extended periods of time without becoming contaminated with microbial growth. The compositions are contemplated, therefore, to be effective in inhibition of microbial contamination or growth.

In certain embodiments, the compositions of the present disclosure may be formulated as cosmetics. The cosmetic preparations may be in the form of a powder, lotion, hydrogel, oil, emulsion, paste, polish or cream. The cosmetics may optionally contain a coloring agent and/or a fragrance.

The compositions of the present disclosure may be used with benefit in virtually all categories of skin cosmetics for both women and men. These would include, but are not limited to preparations formulated as moisturizers, deodorants, anti-aging/skin repair preparations, cleansers and toners, eye care, lip care, fingernail or toenail care, scalp care, sun care, and hand and body preparations. Moreover, after-care products for such skin insults as chemical peels, sunburn, depilatory irritation, razor-shaving nicks and abrasions, scalp irritation from hair perming and straightening, and the like that include the disclosed peptides would fill a much needed void in the cosmetics arena. Many water-based make-up products may be fortified with the disclosed compositions to provide continuing skin therapy during their daily use. The disclosed peptide compositions will also find use in hair care products, such as shampoo, for example. Because of the benefits to skin, shampoos and conditioners are contemplated to be an effective way to deliver the peptides to the scalp.

Compositions including the peptides disclosed herein may also include a cell or tissue growth scaffold. The tissue growth scaffold may preferably be defined as a spinal implant, bone growth scaffold, scaffold for growth of epithelial tissue, a bandage, a non-woven sheet or a woven sheet. It may also be preferable for the non-woven or woven sheets to be keratin derived or to contain natural keratins, including, but not limited to wool pads, woven keratin, keratin bonded to polymer sheets, or cross-linked keratin. Additionally, the tissue growth scaffold may include an envelope containing the peptides or peptides coated or bonded to the surface of a metal, silicone or polymer implant.

DETAILED DESCRIPTION

The present disclosure provides a new family of biologically active peptides derived from plentiful and renewable resources. In a significant number of in vitro cell-culture studies, the present inventor has shown that the cell proliferation activity of the keratin-derived peptides mimic most all of the known growth factors, including FGF, KGF, EGF, and PDGF. In vivo studies in animals have shown that these peptides are potent anti-irritants and that they promote and/or accelerate wound healing. Moreover, these peptides, when applied topically to human volunteers, significantly restore skin barrier properties and rejuvenate aged skin. Based on these early findings, it is concluded that these keratin-derived peptides are "potent" cellular activators effecting both cell proliferation and cell differentiation in mammals, and that they have multiple uses in the medical and cosmetics arenas.

When isolated from natural sources such as human hair or wool, the biologically active peptides can yield one or several soluble peptide fractions from each raw material. These fractions appear to differ from each other mostly in their average molecular weight and their acid solubility. All fractions are readily soluble in the near-neutral pH range used for most cosmetics formulary. In cell culture studies with human fibroblasts, peptide preparations exhibited significant activation of cell proliferation at a concentration of from 100 to 0.001 µg/mL. Based on the data and the activities of known bioactive peptides, it is contemplated that the peptide compositions are active in the range of from 0.0001 to 0.00001 µg/mL. Although the specific cosmetic formulations may affect the delivery of these peptides to and/or through the skin, this in vitro cell-culture result suggests that a useful concentration of the peptides for cell activation could be less than 1%, or less than 0.4%, less than 0.1%, less than 0.01% or even less than 0.001%.

In addition to the in vitro and in vivo studies mentioned above, addition anecdotal information has been gathered regarding the disclosed peptides when opportunities for human experimentation were available. From these studies, it is contemplated that the peptide compositions are both anti-inflammatory and anti-microbial and that they mediate pain at wound-healing sites. Moreover, application of the peptide compositions to skin burns, including chemical burns and sunburn, expedites healing and minimizes discomfort.

The present disclosure arises from the surprising discovery that certain peptide fragments disclosed herein have beneficial biological activities, primarily demonstrated in in vitro studies by their effect on the growth of certain types of biological cells, and particularly dermal fibroblast cells. Because of the ability of certain of the disclosed peptide containing compositions to stimulate or to inhibit growth of fibroblast cells, the compositions find particular utility in applications that involve healing of aging, damage or pathologies of epithelial or connective tissues.

The cytokine-like properties of the peptide compositions can be used to promote healing, repair, and cell growth in keratinous tissue generally. The peptides can be used to treat damaged skin and skin wounds including, for example, rashes, including diaper rash, burns including sunburn, cuts, abrasions, punctures, sores including bed sores, ulcers including diabetic ulcers and other skin injuries or irritations. The peptide compositions can also be used to treat aging, weakened or damaged skin, including, for example, wrinkled skin. Particular applications include the treatment of damaged tissue in the external skin, or epidermal layers, in oral, pulmonary, gastro-intestinal, or spinal tissues.

The peptide containing compositions may be formulated as a powder, lotion, hydrogel, oil, emulsion, paste, cream, or gel for application to the skin or gums, or it may be formulated as an aerosol, an implant, an implant coating or a scaffolding material for tissue growth. For example, the peptide compositions may be contained in a woven or non-woven sheet material, or adsorbed in a hydrogel, or in a hydrogel contained in a biocompatible envelope material.

Preparation of Peptides

In certain embodiments the disclosed peptides may be isolated from naturally occurring sources such as human hair or sheep wool, for example. Preferred methods of preparing a small sample composition containing the claimed peptides follows. It is understood, of course, that this preparation may be made at a much larger scale in order to obtain larger, commercial quantities of the composition.

General methods of producing the peptide containing compositions from a keratin substrate include oxidizing the keratin substrate with an oxidizing agent, to substantially break the disulfide bonds that make keratins insoluble and inert. Examples of oxidizing agents that can be used include, but are not limited to, hydrogen peroxide, peracetic acid, percarbonates, persulfates, chlorine dioxide, sodium and calcium peroxides, perborates, and hypochlorite. The oxidized hair is filtered, the filtrate collected, and neutralized with base. Water soluble peptides from the neutralized filtrate may be precipitated from solution by mixing the filtrate with a water-miscible organic solvent such as methanol. Alternatively the oxidized keratin may be partially or totally dissolved in dilute aqueous alkali, filtered to remove solids, and the filtrate may be precipitated by acidification or by adding a miscible non-solvent such as ethanol or methanol, to obtain a greater fraction of the keratin material. The precipitate is collected with filtration and the collected filtrate is dried.

A more specific protocol follows:

Hot Method

Weigh 100 g of washed cut-up keratin substrate (hair, scoured unbleached, or un-dyed wool, ~0.25-0.5 inches in length) into a 3 L RB flask containing a stirring assembly and gas adaptor Add 1565 mL of distilled, de-ionized (DI) $H_2O$
Add 110 mL of 30% $H_2O_2$
Heat to reflux with stirring
Stir at reflux for ~2 hours
Remove heating mantle
Continue to stir and cool to <50° C. allow to settle and filter using Buchner funnel and fast filter paper
Rinse filtrate twice with 250 mL hot (~50° C.) DI $H_2O$
Save oxidized keratin filtrant (Intermediate A) for further processing later
Allow filtrate to cool to ~room temperature
Neutralize filtrate to pH=7.0±0.2 with ~3N $NH_4OH$
Concentrate with aspirator vacuum to ~165 mL.
Cool to about freezing
Precipitate into 1 L of freezer-cold MeOH
Filter immediately in Buchner funnel with medium-fast filter paper, washing filtrant with 2-250 mL portions of freezer cold MeOH
Alternatively:
Store entire mixture overnight in freezer allowing precipitate to settle
Decant excess MeOH
Filter remaining mixture in Buchner funnel with medium-fast filter paper, washing filtrant with 2-250 mL portions of freezer cold MeOH
Dry filtrant on filter paper overnight in a vacuum oven
Carefully scrape dried material from filter paper into mortar and grind if necessary with a pestle
Weigh product into a labeled glass jar with a Teflon-lined cap, record % SKP (soluble keratin peptide) yield based on keratin substrate, and store product at room temperature.

Enhanced Peptide Yields

Put oxidized keratin filtrant (Intermediate A from Hot Process above) in a 5-L beaker, add 4 L of 0.1 N ammonium hydroxide and stir for 24 hr at room temperature.
Filter solution and discard filtrant.
To filtrate, add glacial acetic acid dropwise with constant stirring to pH 4 causing acid-insoluble peptides to precipitate. Filter with Buchner funnel and save filtrate (acid soluble gamma fraction).
Wash filtrant (acid-insoluble alpha fraction) with 1 L of water and reject washings. Redissolve filtrant in 2 L of 0.01 N ammonium hydroxide and add this solution with constant stirring to 4 L of ethanol containing 10 mL of acetic acid. Filter with Buchner funnel and discard filtrate.
Wash filtrant with 1 L of ethanol and dry filtrant (alpha peptides) in a warm vacuum oven.
Carefully scrape dried material from filter paper and store in a glass jar labeled "alpha peptide".
Take acid-soluble gamma filtrate from the first step, and concentrate it in vacuo to about 200 mL. Pour concentrate into 2 L of ethanol with constant stirring to precipitate gamma peptides.
Recover gamma peptides by filtration with a Buchner funnel and discard filtrate.
Suspend filtrant in 1 L of ethanol and stir for 2 hr to dissolve residual ammonium acetate. Filter with Buchner funnel, discard filtrant, and dry filtrant in a warm vacuum oven.
Carefully scrape dried material from filter paper and store in a glass jar labeled "gamma peptide".

In certain embodiments, the peptides in the disclosed compositions may be chemically synthesized by methods well known in the art. Solid phase peptide synthesis involves a stepwise assembly of a peptide chain while anchored to a support or solid phase peptide resin. There are two generally well-known methods of the solid phase synthesis of peptides.

The first, known as the Merrifield method, utilizes a solid support or resin which holds the C-terminal amino acid by the carboxyl group as the peptide is being synthesized through the attachment of amino acid or peptide residues as building blocks. The N-terminus of the resin-bound peptide is deblocked and N-protected amino acids are added, usually with a coupling agent. Activating agents may be used to improve rate and selectivity. After the peptide bond is formed, the protected group is removed and the cycle is repeated, if desired, until all the amino acids have been added to the peptide in the desired order.

The second method of chemical synthesis is the "polymeric reagent synthesis", also known as the "inverse Merrifield" method. This technique involves reagents bound to solid supports in a series of columns and passing the amino acid or peptide residues through the columns to form the peptide or amino acid sequence.

In certain embodiments, the peptides may be produced recombinantly from isolated nucleic acid molecules that encode the disclosed peptides. For example, the present disclosure provides recombinant cloning and expression vectors containing DNA, as well as host cells containing the recombinant vectors. Expression vectors comprising DNA may be used to prepare the disclosed peptides encoded by the DNA. A method for producing peptides comprises culturing host cells transformed with a recombinant expression vector encoding the peptide, under conditions that promote expression of the peptide, then recovering the expressed peptides from the culture. The skilled artisan will recognize that the procedure for purifying the expressed peptides will vary according to such factors as the type of host cells employed, and the level of purity required for the particular preparation. It is understood that the peptide compositions of the present invention can be of any useful purity, including crude extracts of cell or tissue culture.

Any suitable expression system may be employed. The vectors include a DNA encoding a peptide of the invention, operably linked to suitable transcriptional or translational regulatory nucleotide sequences, such as those derived from a mammalian, microbial, viral, or insect gene. Examples of regulatory sequences include transcriptional promoters, operators, or enhancers, an mRNA ribosomal binding site, and appropriate sequences which control transcription and translation initiation and termination. Nucleotide sequences are operably linked when the regulatory sequence functionally relates to the DNA sequence. Thus, a promoter nucleotide sequence is operably linked to a DNA sequence if the promoter nucleotide sequence controls the transcription of the DNA sequence. An origin of replication that confers the ability to replicate in the desired host cells, and a selection gene by which transformants are identified, are generally incorporated into the expression vector.

In addition, a sequence encoding an appropriate signal peptide (native or heterologous) can be incorporated into expression vectors. A DNA sequence for a signal peptide (secretory leader) may be fused in frame to the nucleic acid sequence of the invention so that the DNA is initially transcribed, and the mRNA translated, into a fusion protein comprising the signal peptide. A signal peptide that is functional in the intended host cells promotes extracellular secretion of the peptide. The signal peptide is cleaved from the peptide upon secretion of peptide from the cell.

Suitable host cells for expression of peptides include prokaryotes, yeast or higher eukaryotic cells. Prokaryotic host cells, such as bacterial cells are generally preferred for use as host cells. Appropriate cloning and expression vectors for use with bacterial, fungal, yeast, and mammalian cellular hosts are described, for example, in Pouwels et al. *Cloning Vectors: A Laboratory Manual*, Elsevier, N.Y., (1985). Cell-free translation systems could also be employed to produce peptides using RNAs derived from DNA constructs disclosed herein.

Prokaryotes include gram-negative or gram-positive organisms. Suitable prokaryotic host cells for transformation include, for example, *E. coli, Bacillus subtilis, Salmonella typhimurium*, and various other species within the genera *Pseudomonas, Streptomyces*, and *Staphylococcus*. In a prokaryotic host cell, such as *E. coli*, a peptide may include an N-terminal methionine residue to facilitate expression of the recombinant peptide in the prokaryotic host cell. The N-terminal Met may be cleaved from the expressed recombinant peptide.

Expression vectors for use in prokaryotic host cells generally comprise one or more phenotypic selectable marker genes. A phenotypic selectable marker gene is, for example, a gene encoding a protein that confers antibiotic resistance or that supplies an autotrophic requirement. Examples of useful expression vectors for prokaryotic host cells include those derived from commercially available plasmids such as the cloning vector pBR322 (ATCC 37017). pBR322 contains genes for ampicillin and tetracycline resistance and thus provides simple means for identifying transformed cells. An appropriate promoter and a DNA sequence are inserted into the pBR322 vector. Other commercially available vectors include, for example, pKK223-3 (Pharmacia Fine Chemicals, Uppsala, Sweden) and pGEM1 (Promega Biotec, Madison, Wis., USA).

Promoter sequences commonly used for recombinant prokaryotic host cell expression vectors include β-lactamase (penicillinase), lactose promoter system (Chang et al., *Nature* 275:615, 1978; and Goeddel et al., *Nature* 281:544, 1979), tryptophan (trp) promoter system (Goeddel et al., *Nucl. Acids Res.* 8:4057, 1980; and EP-A-36776) and tac promoter (Maniatis, *Molecular Cloning: A Laboratory Manual*, Cold Spring Harbor Laboratory, p. 412, 1982). A particularly useful prokaryotic host cell expression system employs a phage $\lambda P_L$ promoter and a cI857ts thermolabile repressor sequence. Plasmid vectors available from the American Type Culture Collection which incorporate derivatives of the $\lambda P_L$ promoter include plasmid pHUB2 (resident in *E. coli* strain JMB9, ATCC 37092) and pPLc28 (resident in *E. coli* RR1, ATCC 53082).

Alternatively, the peptides may be expressed in yeast host cells, preferably from the *Saccharomyces* genus (e.g., *S. cerevisiae*). Other genera of yeast, such as *Pichia* or *Kluyveromyces*, may also be employed. Yeast vectors will often contain an origin of replication sequence from a 2μ yeast plasmid, an autonomously replicating sequence (ARS), a promoter region, sequences for polyadenylation, sequences for transcription termination, and a selectable marker gene. Suitable promoter sequences for yeast vectors include, among others, promoters for metallothionein, 3-phosphoglycerate kinase (Hitzeman et al., *J. Biol. Chem.* 255:2073, 1980) or other glycolytic enzymes (Hess et al., *J. Adv. Enzyme Reg.* 7:149, 1968; and Holland et al., *Biochem.* 17:4900, 1978), such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phospho-glucose isomerase, and glucokinase. Other suitable vectors and promoters for use in yeast expression are further described in Hitzeman, EPA-73,657. Another alternative is the glucose-repressible ADH2 promoter described by Russell et al. (*J. Biol. Chem.* 258:2674, 1982) and Beier et al. (*Nature* 300: 724, 1982). Shuttle vectors replicable in both yeast and *E. coli* may be constructed by inserting DNA sequences from pBR322 for selection and replication in *E. coli* (Amp$^r$ gene and origin of replication) into the above-described yeast vectors.

The yeast α-factor leader sequence may be employed to direct secretion of the peptide. The α-factor leader sequence is often inserted between the promoter sequence and the structural gene sequence. See, e.g., Kurjan et al., *Cell* 30:933, 1982 and Bitter et al., *Proc. Natl. Acad. Sci. USA* 81:5330, 1984. Other leader sequences suitable for facilitating secretion of recombinant peptides from yeast hosts are known to those of skill in the art. A leader sequence may be modified near its 3' end to contain one or more restriction sites. This will facilitate fusion of the leader sequence to the structural gene.

Yeast transformation protocols are known to those of skill in the art. One such protocol is described by Hinnen et al., *Proc. Natl. Acad. Sci. USA* 75:1929, 1978. The Hinnen et al. protocol selects for Trp$^+$ transformants in a selective medium, wherein the selective medium consists of 0.67% yeast nitrogen base, 0.5% casamino acids, 2% glucose, 10 mg/ml adenine and 20 mg/ml uracil.

Yeast host cells transformed by vectors containing an ADH2 promoter sequence may be grown for inducing expression in a "rich" medium. An example of a rich medium is one consisting of 1% yeast extract, 2% peptone, and 1% glucose supplemented with 80 mg/ml adenine and 80 mg/ml uracil. Derepression of the ADH2 promoter occurs when glucose is exhausted from the medium.

Mammalian or insect host cell culture systems also may be employed to express recombinant peptides. Bacculovirus systems for production of heterologous proteins in insect cells are reviewed by Luckow and Summers, *Bio/Technology* 6:47 (1988). Established cell lines of mammalian origin also may be employed. Examples of suitable mammalian host cell lines include the COS-7 line of monkey kidney cells (ATCC CRL 1651) (Gluzman et al., *Cell* 23:175, 1981), L cells, C127 cells, 3T3 cells (ATCC CCL 163), Chinese hamster ovary (CHO) cells, HeLa cells, and BHK (ATCC CRL 10) cell lines, and the CV1/EBNA cell line derived from the African green monkey kidney cell line CV1 (ATCC CCL 70) as described by McMahan et al. (*EMBO J.* 10: 2821, 1991).

Established methods for introducing DNA into mammalian cells have been described (Kaufman, R. J., *Large Scale Mammalian Cell Culture*, 1990, pp. 15-69). Additional protocols using commercially available reagents, such as Lipofectamine lipid reagent (Gibco/BRL) or Lipofectamine-Plus lipid reagent, can be used to transfect cells (Felgner et al., *Proc. Natl. Acad. Sci. USA* 84:7413-7417, 1987). In addition, electroporation can be used to transfect mammalian cells using conventional procedures, such as those in Sambrook et al. (*Molecular Cloning: A Laboratory Manual*, 2 ed. Vol. 1-3, Cold Spring Harbor Laboratory Press, 1989). Selection of stable transformants can be performed using methods known in the art, such as, for example, resistance to cytotoxic drugs. Kaufman et al., *Meth. in Enzymology* 185:487-511, 1990, describes several selection schemes, such as dihydrofolate reductase (DHFR) resistance. A suitable host strain for DHFR selection can be CHO strain DX-B 11, which is deficient in DHFR (Urlaub and Chasin, *Proc. Natl. Acad. Sci. USA* 77:4216-4220, 1980). A plasmid expressing the DHFR cDNA can be introduced into strain DX-B 11, and only cells that contain the plasmid can grow in the appropriate selective media. Other examples of selectable markers that can be incorporated into an expression vector include cDNAs conferring resistance to antibiotics, such as G418 and hygromycin B. Cells harboring the vector can be selected on the basis of resistance to these compounds.

Transcriptional and translational control sequences for mammalian host cell expression vectors can be excised from viral genomes. Commonly used promoter sequences and enhancer sequences are derived from polyoma virus, adenovirus 2, simian virus 40 (SV40), and human cytomegalovirus. DNA sequences derived from the SV40 viral genome, for example, SV40 origin, early and late promoter, enhancer, splice, and polyadenylation sites can be used to provide other genetic elements for expression of a structural gene sequence in a mammalian host cell. Viral early and late promoters are particularly useful because both are easily obtained from a viral genome as a fragment, which can also contain a viral origin of replication (Fiers et al., *Nature* 273:113, 1978; Kaufman, *Meth. in Enzymology*, 1990). Smaller or larger SV40 fragments can also be used, provided the approximately 250 bp sequence extending from the Hind III site toward the Bgl I site located in the SV40 viral origin of replication site is included.

Additional control sequences shown to improve expression of heterologous genes from mammalian expression vectors include such elements as the expression augmenting sequence element (EASE) derived from CHO cells (Morris et al., *Animal Cell Technology*, 1997, pp. 529-534 and PCT Application WO 97/25420) and the tripartite leader (TPL) and VA gene RNAs from Adenovirus 2 (Gingeras et al., *J. Biol. Chem.* 257:13475-13491, 1982). The internal ribosome entry site (IRES) sequences of viral origin allows dicistronic mRNAs to be translated efficiently (Oh and Sarnow, *Current Opinion in Genetics and Development* 3:295-300, 1993; Ramesh et al., *Nucleic Acids Research* 24:2697-2700, 1996). Expression of a heterologous cDNA as part of a dicistronic mRNA followed by the gene for a selectable marker (e.g. DHFR) has been shown to improve transfectability of the host and expression of the heterologous cDNA (Kaufman, *Meth. in Enzymology*, 1990). Exemplary expression vectors that employ dicistronic mRNAs are pTR-DC/GFP described by Mosser et al., *Biotechniques* 22:150-161, 1997, and p2A5I described by Morris et al., *Animal Cell Technology*, 1997, pp. 529-534.

A useful high expression vector, pCAVNOT, has been described by Mosley et al., *Cell* 59:335-348, 1989. Other expression vectors for use in mammalian host cells can be constructed as disclosed by Okayama and Berg (*Mol. Cell. Biol.* 3:280, 1983). A useful system for stable high level expression of mammalian cDNAs in C127 murine mammary epithelial cells can be constructed substantially as described by Cosman et al. (*Mol. Immunol.* 23:935, 1986). A useful high expression vector, PMLSV N1/N4, described by Cosman et al., *Nature* 312:768, 1984, has been deposited as ATCC 39890. Additional useful mammalian expression vectors are described in EP-A-0367566, and in WO 91/18982, incorporated by reference herein. In yet another alternative, the vectors can be derived from retroviruses.

The disclosure also includes methods of isolating and purifying the peptides. The "isolated" peptides encompassed by this invention are peptides that are not in an environment identical to an environment in which they can be found in nature. The "purified" peptides or fragments thereof encompassed by this invention are essentially free of association with other proteins or polypeptides, for example, as a purification product of recombinant expression systems such as those described above or as a purified product from a nonrecombinant source such as naturally occurring cells and/or tissues, or as peptides isolated from the native keratin proteins in which they occur.

In one preferred embodiment, the purification of recombinant peptides or fragments can be accomplished using fusions of peptides or fragments of the invention to another polypeptide to aid in the purification of peptides or fragments of the invention. Such fusion partners can include the poly-His or other antigenic identification peptides described above as well as the Fc moieties.

Pharmaceutical Compositions

Compositions comprising an effective amount of a peptide or combination of peptides of the present invention, in combination with other components such as a physiologically acceptable diluent, carrier, or excipient, are provided herein. The peptides can be formulated according to known methods used to prepare pharmaceutically useful compositions. They can be combined in admixture, either as the sole active material or with other known active materials suitable for a given indication, with pharmaceutically acceptable diluents (e.g., saline, Tris-HCl, acetate, and phosphate buffered solutions), preservatives (e.g., thimerosal, benzyl alcohol, parabens), emulsifiers, solubilizers, adjuvants and/or carriers. A peptide may be formulated into a composition in a neutral or salt form. Pharmaceutically acceptable salts, include the acid addition salts (formed with the free amino groups of the peptide) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. The compositions disclosed herein may be formulated in any appropriate delivery vehicle, including, but not limited to hydrogels, lotions, aqueous solutions, non-aqueous solutions, non-woven mediums, woven mediums, tissue or cell growth scaffolds and powders. Suitable formulations for pharmaceutical compositions include those described in *Remington's Pharmaceutical Sciences*, 16th ed. 1980, Mack Publishing Company, Easton, Pa.

In addition, such compositions can be complexed with polyethylene glycol (PEG), metal ions, or incorporated into polymeric compounds such as polylactic acid, polyglycolic acid, hydrogels, dextran, etc., or incorporated into liposomes, microemulsions, micelles, unilamellar or multilamellar vesicles, erythrocyte ghosts or spheroblasts. Such compositions will influence the physical state, solubility, stability, rate of in vivo release, and rate of in vivo clearance, and are thus chosen according to the intended application.

The compositions of the invention can be administered in any suitable manner, e.g., topically, parenterally, or by inhalation. The term "parenteral" includes injection, e.g., by subcutaneous, intravenous, or intramuscular routes, also including localized administration, e.g., at a site of disease or injury. Sustained release from implants is also contemplated. One skilled in the pertinent art will recognize that suitable dosages will vary, depending upon such factors as the nature of the disorder to be treated, the patient's body weight, age, and general condition, and the route of administration. Preliminary doses can be determined according to animal tests, and the scaling of dosages for human administration is performed according to art-accepted practices.

In certain preferred embodiments of use, the peptide containing compositions may be formulated as a powder to be placed over a wound, for example. The peptide powder can also be formulated into any water-based solution, cream, gel, or other vehicle for convenient application to a wound. In addition, a peptide solution could be incorporated into or cast onto a polymer wound dressing or a keratin wound dressing sheet for application to a wound. In in vitro trials, compositions containing the disclosed peptides were shown to enhance proliferation of human skin keratinocytes, human dermal fibroblasts, and microvascular endothelial cells, thus demonstrating the efficacy of the peptides in wound-healing applications.

The peptides can also be added as a cell growth stimulant to a tissue engineering scaffold such as the sheet described in U.S. Pat. No. 6,110,487, incorporated herein by reference. The peptides are contemplated to speed repair of sun or weather damaged skin. The peptides may be mixed with a carrier lotion such as lanolin and applied to the skin. The peptides may also be added to cosmetics to impart a skin healing property to the cosmetic. Cosmetic bases are believed suitable for inclusion of peptides made according to the present invention.

In certain embodiments, the peptides compositions disclosed herein may be included in, attached to, or adhered to other products, including wound dressings, woven or non-woven sheets or films, hydrogel preparations, tissue engineering scaffolds, implants, or metal or polymer materials. Such materials are described in commonly owned U.S. Pat. Nos. 5,358,935, 5,932,552, 6,274,163, 6,124,265, 6,432,435, 6,316,598, 6,371,984, 6274,155, 6,270,793, 6,461,628, and U.S. patent application Ser. No. 09/815,387, all of which are incorporated herein by reference.

Peptide Containing Compositions

In previous studies, crude compositions containing the disclosed peptides have been used to investigate the mitogenic effects on keratinocytes after 3 days of exposure. Peptide concentrations of 0.5 to 10 ug/ml produced increases in optical densities (OD) at 530 nanometer (nm) of greater than 20% compared to negative controls. One exception was the 5 ug/ml concentration that produced over a 15% greater response. The positive control in these studies, epidermal growth factor (EGF25), produced greater than 20% increase in cell proliferation. In a similar study, after 5 days of exposure the keratinocyte proliferation was 25% or greater for peptide concentrations of 0.5 to 10 ug/ml. The positive control, EGF25, also produced a greater than 25% increase.

A second set of studies was performed that tested the biological effect of the peptide compositions on human dermal fibroblasts after three and five days of exposure. After three days of exposure, the peptide composition produced a greater than 25% increase in cell proliferation at concentrations between 0.5 and 10 ug/ml. The positive control, bovine-derived fibroblast growth factor (bFGF25), produced a greater than 30% increase in cell proliferation. After five days of exposure, peptide compositions at a concentration of 0.5 to 10 ug/ml produced increases in cell proliferation of between 9% and 12%. The positive control produced a greater than 13% increase.

Related in vitro tests confirmed that the mitogenic effect of the peptide compositions on dermal fibroblasts increased with concentration up to nearly 150% of the negative control at 1000 ug/ml concentration. Compositions with greater purity increased the mitogenic effect to over 1000% of the negative control. The positive control in these studies, platelet derived growth factor (PDGF), increased the mitogenic effect to nearly 700% of the negative control.

The present disclosure includes further refined preparations that can be separated into two distinct components, the first, alpha-keratose comprises about 60% of the total peptides and is water soluble and acid insoluble. The gamma keratose is both acid and water soluble. Compositions containing mixtures of the disclosed peptides at various concentrations from the alpha and gamma fractions from hair and wool were added to dermal fibroblast cell cultures for three and five days. The cellular response was measured using optical density techniques (OD490) to quantify the cell proliferation. In all cases the highest concentrations produced a greater cell proliferation response than the lower concentrations after three days of exposure. The 100 ug/ml concentration of the peptides from hair and wool produced approximately a 35% and 30% increase in cell proliferation respectively compared to the negative control.

Human dermal fibroblasts were also exposed to alpha and gamma fractions of the peptide compositions products from hair and wool for five days. The negative control was saline, and FGF was used as a positive control. The compositions containing the alpha and gamma fractions of the peptides from hair and wool at 1 and 10 ug/ml concentrations produced an increase in cell proliferation of between 30% and 60% compared to the control.

The peptide compositions reported above were fractionated and amino acid sequences obtained using tandem mass spectrometry (MS/MS). Based on the amino acid sequence data and comparison to known hair and wool keratin proteins, the peptides were localized to a conserved region of human hair and sheep wool keratin proteins. By these sequence comparisons the bioactive peptides are shown to be derived from the following conserved consensus sequence:

```
EVNTLR(C/S)(Q/P)LGDRLNVEVD(A/T)APTVDLN(Q/R)VLNETR(S/N)
QYEAL
The peptide compositions of the present disclosure may contain, therefore,
any of the following peptides in any combination.
EVNTLRCQLGDRLNVEVDAAPTVDLNQVLNETRSQYEAL,               SEQ ID NO:1
EVNTLRSQLGDRLNVEVDAAPTVDLNQVLNETRSQYEAL,               SEQ ID NO:2
EVNTLRCPLGDRLNVEVDAAPTVDLNQVLNETRSQYEAL,               SEQ ID NO:3
EVNTLRSPLGDRLNVEVDAAPTVDLNQVLNETRSQYEAL,               SEQ ID NO:4
EVNTLRCQLGDRLNVEVDTAPTVDLNQVLNETRSQYEAL,               SEQ ID NO:5
EVNTLRSQLGDRLNVEVDTAPTVDLNQVLNETRSQYEAL,               SEQ ID NO:6
EVNTLRCPLGDRLNVEVDTAPTVDLNQVLNETRSQYEAL,               SEQ ID NO:7
EVNTLRSPLGDRLNVEVDTAPTVDLNQVLNETRSQYEAL,               SEQ ID NO:8
EVNTLRCQLGDRLNVEVDAAPTVDLNRVLNETRSQYEAL,               SEQ ID NO:9
EVNTLRSQLGDRLNVEVDAAPTVDLNRVLNETRSQYEAL,               SEQ ID NO:10
EVNTLRCPLGDRLNVEVDAAPTVDLNRVLNETRSQYEAL,               SEQ ID NO:11
EVNTLRSPLGDRLNVEVDAAPTVDLNRVLNETRSQYEAL,               SEQ ID NO:12
EVNTLRCQLGDRLNVEVDTAPTVDLNRVLNETRSQYEAL,               SEQ ID NO:13
EVNTLRSQLGDRLNVEVDTAPTVDLNRVLNETRSQYEAL,               SEQ ID NO:14
EVNTLRCPLGDRLNVEVDTAPTVDLNRVLNETRSQYEAL,               SEQ ID NO:15
EVNTLRSPLGDRLNVEVDTAPTVDLNRVLNETRSQYEAL,               SEQ ID NO:16
EVNTLRCQLGDRLNVEVDAAPTVDLNQVLNETRNQYEAL,               SEQ ID NO:17
EVNTLRSQLGDRLNVEVDAAPTVDLNQVLNETRNQYEAL,               SEQ ID NO:18
EVNTLRCPLGDRLNVEVDAAPTVDLNQVLNETRNQYEAL,               SEQ ID NO:19
EVNTLRSPLGDRLNVEVDAAPTVDLNQVLNETRNQYEAL,               SEQ ID NO:20
EVNTLRCQLGDRLNVEVDTAPTVDLNQVLNETRNQYEAL,               SEQ ID NO:21
EVNTLRSQLGDRLNVEVDTAPTVDLNQVLNETRNQYEAL,               SEQ ID NO:22
EVNTLRCPLGDRLNVEVDTAPTVDLNQVLNETRNQYEAL,               SEQ ID NO:23
EVNTLRSPLGDRLNVEVDTAPTVDLNQVLNETRNQYEAL,               SEQ ID NO:24
EVNTLRCQLGDRLNVEVDAAPTVDLNRVLNETRNQYEAL,               SEQ ID NO:25
EVNTLRSQLGDRLNVEVDAAPTVDLNRVLNETRNQYEAL,               SEQ ID NO:26
EVNTLRCPLGDRLNVEVDAAPTVDLNRVLNETRNQYEAL,               SEQ ID NO:27
EVNTLRSPLGDRLNVEVDAAPTVDLNRVLNETRNQYEAL,               SEQ ID NO:28
EVNTLRCQLGDRLNVEVDTAPTVDLNRVLNETRNQYEAL,               SEQ ID NO:29
EVNTLRSQLGDRLNVEVDTAPTVDLNRVLNETRNQYEAL,               SEQ ID NO:30
EVNTLRCPLGDRLNVEVDTAPTVDLNRVLNETRNQYEAL,               SEQ ID NO:31
EVNTLRSPLGDRLNVEVDTAPTVDLNRVLNETRNQYEAL,               SEQ ID NO:32
EVNT, SEQ ID NO:33;         VNTL, SEQ ID NO:34;     NTLR, SEQ ID NO:35;
TLRC, SEQ ID NO:36;         TLRS, SEQ ID NO:37;     LRCQ, SEQ ID NO:38;
LRCP, SEQ ID NO:39;         LRSQ, SEQ ID NO:40;     LRSP, SEQ ID NO:41;
RCQL, SEQ ID NO:42,         RSQL, SEQ ID NO:43;     RCPL, SEQ ID NO:44;
RSPL, SEQ ID NO:45;         CQLG, SEQ ID NO:46;     CPLG, SEQ ID NO:47;
SQLG, SEQ ID NO:48;         SPLG, SEQ ID NO:49;     QLGD, SEQ ID NO:50;
PLGD, SEQ ID NO:51;         LGDR, SEQ ID NO:52;     GDRL, SEQ ID NO:53;
DRLN, SEQ ID NO:54;         RLNV, SEQ ID NO:55;     LNVE, SEQ ID NO:56;
NVEV, SEQ ID NO:57;         VEVD, SEQ ID NO:58;     EVDA, SEQ ID NO:59;
EVDT, SEQ ID NO:60;         VDAA, SEQ ID NO:61;     VDTA, SEQ ID NO:62;
DAAP, SEQ ID NO:63;         DTAP, SEQ ID NO:64;     AAPT, SEQ ID NO:65;
TATP, SEQ ID NO:66;         APTV, SEQ ID NO:67;     PTVD, SEQ ID NO:68;
TVDL, SEQ ID NO:69;         VDLN, SEQ ID NO:70;     DLNQ, SEQ ID NO:71;
DLNR, SEQ ID NO:72;         LNQV, SEQ ID NO:73;     LNRV, SEQ ID NO:74;
NQVL, SEQ ID NO:75;         NRVL, SEQ ID NO:76;     QVLN, SEQ ID NO:77;
RVLN, SEQ ID NO:78;         VLNE, SEQ ID NO:79;     LNET, SEQ ID NO:80;
NETR, SEQ ID NO:81;         ETRS, SEQ ID NO:82;     ETRN, SEQ ID NO:83;
TRSQ, SEQ ID NO:84;         TRNQ, SEQ ID NO:85;     RSQY, SEQ ID NO:86;
RNQY, SEQ ID NO:87;         SQYB, SEQ ID NO:88;     NQYE, SEQ ID NO:89;
QYEA, SEQ ID NO:90;         YEAL, SEQ ID NO:91;     EVNTL, SEQ ID NO:92;
VNTLR, SEQ ID NO:93;        NTLRC, SEQ ID NO:94;    NTLRS, SEQ ID NO:95;
TLRCQ, SEQ ID NO:96;        TLRSQ, SEQ ID NO:97;    TLRCP98; TLRSP; SEQ ID
                                                    NO:99;
```

-continued

| | | |
|---|---|---|
| LRCPL, SEQ ID NO:100; | LRCPL, SEQ ID NO:101; | LRSQL, SEQ ID NO:102; |
| LRSPL, SEQ ID NO:103; | RCQLG, SEQ ID NO:104; | RCPLG, SEQ ID NO:105; |
| RSQLG, SEQ ID NO:106; | RSPLG, SEQ ID NO:107; | CQLGD, SEQ ID NO:108; |
| CPLGD, SEQ ID NO:109; | SQLGD, SEQ ID NO:110; | SPLUD, SEQ ID NO:111; |
| QLGDR, SEQ ID NO:112; | PLGDR, SEQ ID NO:112; | LGDRL, SEQ ID NO:113; |
| GDRLN, SEQ ID NO:114; | DRLNV, SEQ ID NO:115; | RLNVE, SEQ ID NO:116; |
| LNVEV, SEQ ID NO:117; | NVEVD, SEQ ID NO:118; | VEVDA, SEQ ID NO:119; |
| VEVDT, SEQ ID NO:120; | EVDAA, SEQ ID NO:121; | EVDTA, SEQ ID NO:122; |
| VDAAP, SEQ ID NO:123; | VDTAP, SEQ ID NO:124; | DAAPT, SEQ ID NO:125; |
| DTAPT, SEQ ID NO:126; | AAPTV, SEQ ID NO:127; | TAPTV, SEQ ID NO:128; |
| APTVD, SEQ ID NO:129; | PTVDL, SEQ ID NO:130; | TVDLN, SEQ ID NO:131; |
| VDLNQ, SEQ ID NO:132; | VDLNR, SEQ ID NO:133; | DLNQV, SEQ ID NO:134; |
| DLNRV, SEQ ID NO:135; | LNQVL, SEQ ID NO:136; | LNRVL, SEQ ID NO:137; |
| NQVLN, SEQ ID NO:138; | NRVLN, SEQ ID NO:139; | QVLNE, SEQ ID NO:140; |
| RVLNE, SEQ ID NO:141; | VLNET, SEQ ID NO:142; | LNETR, SEQ ID NO:143; |
| NETRS, SEQ ID NO:144; | NETRN, SEQ ID NO:145; | ETRSQ, SEQ ID NO:146; |
| ETRNQ, SEQ ID NO:147; | TRSQY, SEQ ID NO:148; | TRNQY, SEQ ID NO:149; |
| RSQYE, SEQ ID NO:150; | RNQYE, SEQ ID NO:151; | SQYEA, SEQ ID NO:152; |
| NQYEA, SEQ ID NO:153; | QYEAL, SEQ ID NO:154; | EVNTLR, SEQ ID NO:155; |
| VNTLRC, SEQ ID NO:156; | VNTLRS, SEQ ID NO:157; | NTLRCQ, SEQ ID NO:158; |
| NTLRCP, SEQ ID NO:159; | NTLRSQ, SEQ ID NO:160; | NTLRSP, SEQ ID NO:161; |
| TLRCQL, SEQ ID NO:162; | TLRCPL, SEQ ID NO:163; | TLRSQL, SEQ ID NO:164; |
| TLRSPL, SEQ ID NO:165; | LRCQLG, SEQ ID NO:166; | LRCPLG, SEQ ID NO:167; |
| LRSQLG, SEQ ID NO:168; | LRSPLG, SEQ ID NO:169; | RCQLGD, SEQ ID NO:170; |
| RCPLGD, SEQ ID NO:171; | RSQLGD, SEQ ID NO:172; | RSPLGD, SEQ ID NO:173; |
| CQLGDR, SEQ ID NO:174; | CPLGDR, SEQ ID NO:175; | SQLGDR, SEQ ID NO:176; |
| SPLGDR, SEQ ID NO:177; | QLGDRL, SEQ ID NO:178; | PLGDRL, SEQ ID NO:179; |
| LGDRLN, SEQ ID NO:180; | GDRLNV, SEQ ID NO:181; | DRLNVE, SEQ ID NO:182; |
| RLNVEV, SEQ ID NO:183; | LNVEVD, SEQ ID NO:184; | NVEVDA, SEQ ID NO:185; |
| NVEVDT, SEQ ID NO:186; | VEVDAA, SEQ ID NO:187; | VEVDTA, SEQ ID NO:188; |
| EVDAAP, SEQ ID NO:189; | EVDTAP, SEQ ID NO:190; | VDAAPT, SEQ ID NO:191; |
| VDTAPT, SEQ ID NO:192; | DAAPTV, SEQ ID NO:193; | DTAPTV, SEQ ID NO:194; |
| AAPTVD, SEQ ID NO:195; | TAPTVD, SEQ ID NO:196; | APTVDL, SEQ ID NO:197; |
| PTVDLN, SEQ ID NO:198; | TVDLNQ, SEQ ID NO:199; | TVDLNR, SEQ ID NO:200; |
| VDLNQV, SEQ ID NO:201; | VDLNRV, SEQ ID NO:202; | DLNQVL, SEQ ID NO:203; |
| DLNRVL, SEQ ID NO:204; | LNQVLN, SEQ ID NO:205; | LNRVLN, SEQ ID NO:206; |
| NQVLNE, SEQ ID NO:207; | NRVLNE, SEQ ID NO:208; | QVLNET, SEQ ID NO:209; |
| RVLNET, SEQ ID NO:210; | VLNETR, SEQ ID NO:211; | LNETRS, SEQ ID NO:212; |
| LNETRN, SEQ ID NO:213; | NETRSQ, SEQ ID NO:214; | NETRNQ, SEQ ID NO:215; |
| ETRSQY, SEQ ID NO:216; | ETRNQY, SEQ ID NO:217; | TRSQYE, SEQ ID NO:218; |
| TRNQYE, SEQ ID NO:219; | RSQYEA, SEQ ID NO:220; | RNQYEA, SEQ ID NO:221; |
| SQYEAL, SEQ ID NO:222; | NQYEAL, SEQ ID NO:223; | EVNTLRC, SEQ ID NO:224; |
| EVNTLRS, SEQ ID NO:225; | VNTLRCQ, SEQ ID NO:226; | VNTLRCP, SEQ ID NO:227; |
| VNTLRSQ, SEQ ID NO:228; | VNTLRSP, SEQ ID NO:229; | NTLRCQL, SEQ ID NO:230; |
| NTLRCPL SEQ ID NO 231; | NTLRSQL, SEQ ID NO:232; | NTLRSPL, SEQ ID NO:233; |
| TLRCQLG, SEQ ID NO:234; | TLRCPLG, SEQ ID NO:235; | |
| TLRSQLG, SEQ ID NO:236; | TLRSPLG, SEQ ID NO:237; | |
| LRCQLGD, SEQ ID NO:238; | LRCPLGD, SEQ ID NO:239; | |
| LRSQLGD, SEQ ID NO:240; | LRSPLGD, SEQ ID NO:241; | |
| RCQLGDR, SEQ ID NO:242; | RCPLGDR, SEQ ID NO:243; | |
| RSQLGDR, SEQ ID NO:244; | RSPLGDR, SEQ ID NO:245; | |
| CQLGDRL, SEQ ID NO:246; | CPLGDRL, SEQ ID NO:247; | |
| SQLGDRL, SEQ ID NO:248; | SPLGDRL, SEQ ID NO:249; | |
| QLGDRLN, SEQ ID NO:250; | PLGDRLN, SEQ ID NO:251; | |
| LGDRLNV, SEQ ID NO:252; | GDRLNVE, SEQ ID NO:253; | |
| DRLNVEV, SEQ ID NO:254; | RLNVEVD, SEQ ID NO:255; | |
| LNVEVDA, SEQ ID NO:256; | LNVEVDT, SEQ ID NO:257; | |
| NVEVDAA, SEQ ID NO:258; | NVEVDTA, SEQ ID NO:259; | |
| VEVDAAP, SEQ ID NO:260; | VEVDTAP, SEQ ID NO:261; | |
| EVDAAPT, SEQ ID NO:262; | EVDTAPT, SEQ ID NO:263; | |
| VDAAPTV, SEQ ID NO:264; | VDTAPTV, SEQ ID NO:265; | |
| DAAPTVD, SEQ ID NO:266; | DTAPTVD, SEQ ID NO:267; | |
| AAPTVDL, SEQ ID NO:268; | TAPTVDL, SEQ ID NO:269; | |
| APTVDLN, SEQ ID NO:270; | PTVDLNQ, SEQ ID NO:271; | |
| PTVDLNR, SEQ ID NO:272; | TVDLNQV, SEQ ID NO:273; | |
| TVDLNRV, SEQ ID NO:274; | VDLNQVL, SEQ ID NO:275; | |
| VDLNRVL, SEQ ID NO:276; | DLNQVLN, SEQ ID NO:277; | |
| DLNRVLN, SEQ ID NO:278; | LNQVLNE, SEQ ID NO:279; | |
| LNRVLNE, SEQ ID NO:280; | NQVLNET, SEQ ID NO:281; | |
| NRVLNET, SEQ ID NO:282; | QVLNETR, SEQ ID NO:283; | |
| RVLNETR, SEQ ID NO:284; | VLNETRS, SEQ ID NO:285; | |
| VLNETRN, SEQ ID NO:286; | LNETRSQ, SEQ ID NO:287; | |
| LNETRNQ, SEQ ID NO:288; | NETRSQY, SEQ ID NO:289; | |
| NETRNQY, SEQ ID NO:290; | ETRSQYE, SEQ ID NO:291; | |
| ETRNQYE, SEQ ID NO:292; | TRSQYEA, SEQ ID NO:293; | |
| TRNQYEA, SEQ ID NO:294; | RSQYEAL, SEQ ID NO:295; | |
| RNQYEAL, SEQ ID NO:296; | EVNTLRCQ, SEQ ID NO:297; | |
| EVNTLRCP, SEQ ID NO:298; | EVNTLRSQ, SEQ ID NO:299; | |
| EVNTLRSP, SEQ ID NO:300; | VNTLRCQL, SEQ ID NO:301; | |
| VNTLRCPL, SEQ ID NO:302; | VNTLRSQL, SEQ ID NO:303; | |

-continued

| | |
|---|---|
| VNTLRSPL, SEQ ID NO:304; | NTLRCQLG, SEQ ID NO:305; |
| NTLRCPLG, SEQ ID NO:306; | NTLRSQLG, SEQ ID NO:307; |
| NTLRSPLG, SEQ ID NO:308; | TLRCQLGD, SEQ ID NO:309; |
| TLRCPLGD, SEQ ID NO:310; | TLRSQLGD, SEQ ID NO:311; |
| TLRSPLGD, SEQ ID NO:312; | LRCQLGDR, SEQ ID NO:313; |
| LRCPLGDR, SEQ ID NO:314; | LRSQLGDR, SEQ ID NO:315; |
| LRSPLGDR, SEQ ID NO:316; | RCQLGDRL, SEQ ID NO:317; |
| RCPLGDRL, SEQ ID NO:318; | RSQLGDRL, SEQ ID NO:319; |
| RSPLGDRL, SEQ ID NO:320; | CQLGDRLN, SEQ ID NO:321; |
| CPLGDRLN, SEQ ID NO:322; | SQLGDRLN, SEQ ID NO:323; |
| SPLGDRLN, SEQ ID NO:324; | QLGDRLNV, SEQ ID NO:325; |
| PLGDRLNV, SEQ ID NO:326; | LGDRLNVE, SEQ ID NO:327; |
| GDRLNVEV, SEQ ID NO:328; | DRLNVEVD, SEQ ID NO:329; |
| RLNVEVDA, SEQ ID NO:330; | RLNVEVDT, SEQ ID NO:331; |
| LNVEVDAA, SEQ ID NO:332; | LNVEVDTA, SEQ ID NO:333; |
| NVEVDAAP, SEQ ID NO:334; | NVEVDTAP, SEQ ID NO:335; |
| VEVDAAPT, SEQ ID NO:336; | VEVDTAPT, SEQ ID NO:337; |
| EVDAAPTV, SEQ ID NO:338; | EVDTAPTV, SEQ ID NO:339; |
| VDAAPTVD, SEQ ID NO:340; | VDTAPTVD, SEQ ID NO:341; |
| DAAPTVDL, SEQ ID NO:342; | DTAPTVDL, SEQ ID NO:343; |
| AAPTVDLN, SEQ ID NO:344; | TAPTVDLN, SEQ ID NO:345; |
| APTVDLNQ, SEQ ID NO:346; | APTVDLNR, SEQ ID NO:347; |
| PTVDLNQV, SEQ ID NO:348; | PTVDLNRV, SEQ ID NO:349; |
| TVDLNQVL, SEQ ID NO:350; | TVDLNRVL, SEQ ID NO:351; |
| VDLNQVLN, SEQ ID NO:352; | VDLNRVLN, SEQ ID NO:353; |
| DLNQVLNE, SEQ ID NO:354; | DLNRVLNE, SEQ ID NO:355; |
| LNQVLNET, SEQ ID NO:356; | LNRVLNET, SEQ ID NO:357; |
| NQVLNETR, SEQ ID NO:358; | NRVLNETR, SEQ ID NO:359; |
| QVLNETRS, SEQ ID NO:360; | QVLNETRN, SEQ ID NO:361; |
| RVLNETRS, SEQ ID NO:362; | RVLNETRN, SEQ ID NO:363; |
| VLNETRSQ, SEQ ID NO:364; | VLNETRNQ, SEQ ID NO:365; |
| LNETRSQY, SEQ ID NO:366; | LNETRNQY, SEQ ID NO:367; |
| NETRSQYE, SEQ ID NO:368; | NETRNQYE, SEQ ID NO:369; |
| ETRSQYEA, SEQ ID NO:370; | ETRNQYEA, SEQ ID NO:371; |
| TRSQYEAL, SEQ ID NO:372; | TRNQYEAL, SEQ ID NO:373; |
| EVNTLRCQL, SEQ ID NO:374; | EVNTLRCPL, SEQ ID NO:375; |
| EVNTLRSQL, SEQ ID NO:376; | EVNTLRSPL, SEQ ID NO:377; |
| VNTLRCQLG, SEQ ID NO:378; | VNTLRCPLG, SEQ ID NO:379; |
| VNTLRSQLG, SEQ ID NO:380; | VNTLRSPLG, SEQ ID NO:381; |
| NTLRCQLGD, SEQ ID NO:382; | NTLRCPLGD, SEQ ID NO:383; |
| NTLRSQLGD, SEQ ID NO:384; | NTLRSPLGD, SEQ ID NO:385; |
| TLRCQLGDR, SEQ ID NO:386; | TLRCPLGDR, SEQ ID NO:387; |
| TLRSQLGDR, SEQ ID NO:388; | TLRSPLGDR, SEQ ID NO:389; |
| LRCQLGDRL, SEQ ID NO:390; | LRCPLGDRL, SEQ ID NO:391; |
| LRSQLGDRL, SEQ ID NO:392; | LRSPLGDRL, SEQ ID NO:393; |
| RCQLGDRLN, SEQ ID NO:394; | RCPLGDRLN, SEQ ID NO:395; |
| RSQLGDRLN, SEQ ID NO:396; | RSPLGDRLN, SEQ ID NO:397; |
| CQLGDRLNV, SEQ ID NO:398; | CPLGDRLNV, SEQ ID NO:399; |
| SQLGDRLNV, SEQ ID NO:400; | SPLGDRLNV, SEQ ID NO:401; |
| QLGDRLNVE, SEQ ID NO:402; | PLGDRLNVE, SEQ ID NO:403; |
| LGDRLNVEV, SEQ ID NO:404; | GDRLNVEVD, SEQ ID NO:405; |
| DRLNVEVDA, SEQ ID NO:406; | DRLNVEVDT, SEQ ID NO:407; |
| RLNVEVDAA, SEQ ID NO:408; | RLNVEVDTA, SEQ ID NO:409; |
| LNVEVDAAP, SEQ ID NO:410; | LNVEVDTAP, SEQ ID NO:411; |
| NVEVDTAPT, SEQ ID NO:412; | NVEVDAAPT, SEQ ID NO:413; |
| VEVDAAPTV, SEQ ID NO:414; | VEVDTAPTV, SEQ ID NO:415; |
| EVDAAPTVD, SEQ ID NO:416; | EVDTAPTVD, SEQ ID NO:417; |
| VDAAPTVDL, SEQ ID NO:418; | VDTAPTVDL, SEQ ID NO:419; |
| DAAPTVDLN, SEQ ID NO:420; | DTAPTVDLN, SEQ ID NO:421; |
| AAPTVDLNQ, SEQ ID NO:422; | AAPTVDLNR, SEQ ID NO:423; |
| TAPTVDLNQ, SEQ ID NO:424; | TAPTVDLNR, SEQ ID NO:425; |
| APTVDLNQV, SEQ ID NO:426; | APTVDLNRV, SEQ ID NO:427; |
| PTVDLNQVL, SEQ ID NO:428; | PTVDLNRVL, SEQ ID NO:429; |
| TVDLNQVLN, SEQ ID NO:430; | TVDLNRVLN, SEQ ID NO:431; |
| VDLNQVLNE, SEQ ID NO:432; | VDLNRVLNE, SEQ ID NO:433; |
| DLNQVLNET, SEQ ID NO:434; | DLNRVLNET, SEQ ID NO:435; |
| LNQVLNETR, SEQ ID NO:436; | LNRVLNETR, SEQ ID NO:437; |
| NQVLNETRS, SEQ ID NO:438; | NQVLNETRN, SEQ ID NO:439; |
| NRVLNETRS, SEQ ID NO:440; | NRVLNETRN, SEQ ID NO:441; |
| QVLNETRSQ, SEQ ID NO:442; | QVLNETRNQ, SEQ ID NO:443; |
| RVLNETRSQ, SEQ ID NO:444; | RVLNETRNQ, SEQ ID NO:445; |
| VLNETRSQY, SEQ ID NO:446; | VLNETRNQY, SEQ ID NO:447; |
| LNETRSQYE, SEQ ID NO:448; | LNETRNQYE, SEQ ID NO:449; |
| NETRSQYEA, SEQ ID NO:450; | NETRNQYEA, SEQ ID NO:451; |
| ETRSQYEAL, SEQ ID NO:452; | ETRNQYEAL, SEQ ID NO:453; |
| EVNTLRCQLG, SEQ ID NO:454; | EVNTLRCPLG, SEQ ID NO:455; |
| EVNTLRSQLG, SEQ ID NO:456; | EVNTLRSPLG, SEQ ID NO:457; |
| VNTLRCQLGD, SEQ ID NO:458; | VNTLRCPLGD, SEQ ID NO:459; |
| VNTLRSQLGD, SEQ ID NO:460; | VNTLRSPLGD, SEQ ID NO:461; |
| NTLRCQLGDR, SEQ ID NO:462; | NTLRCPLGDR, SEQ ID NO:463; |

-continued

```
NTLRSQLGDR, SEQ ID NO:464;      NTLRSPLGDR, SEQ ID NO:465;
TLRCQLGDRL, SEQ ID NO:466;      TLRCPLGDRL, SEQ ID NO:467;
TLRSQLGDRL, SEQ ID NO:468;      TLRSPLGDRL, SEQ ID NO:469;
LRCQLGDRLN, SEQ ID NO:470;      LRCPLGDRLN, SEQ ID NO:471;
LRSQLGDRLN, SEQ ID NO:472;      LRSPLGDRLN, SEQ ID NO:473;
RCQLGDRLNV, SEQ ID NO:474;      RCPLGDRLNV, SEQ ID NO:475;
RSQLGDRLNV, SEQ ID NO:476;      RSPLGDRLNV, SEQ ID NO:477;
CQLGDRLNVE, SEQ ID NO:478;      CPLGDRLNVE, SEQ ID NO:479;
SQLGDRLNVE, SEQ ID NO:480;      SPLGDRLNVE, SEQ ID NO:481;
QLGDRLNVEV, SEQ ID NO:482;      PLGDRLNVEV, SEQ ID NO:483;
LGDRLNVEVD, SEQ ID NO:484;      GDRLNVEVDA, SEQ ID NO:485;
GDRLNVEVDT, SEQ ID NO:486;      DRLNVEVDAA, SEQ ID NO:487;
DRLNVEVDTA, SEQ ID NO:488;      RLNVEVDAAP, SEQ ID NO:489;
RLNVEVDTAP, SEQ ID NO:490;      LNVEVDAAPT, SEQ ID NO:491;
LNVEVDTAPT, SEQ ID NO:492;      NVEVDAAPTV, SEQ ID NO:493;
NVEVDTAPTV, SEQ ID NO:494;      VEVDAAPTVD, SEQ ID NO:495;
VEVDTAPTVD, SEQ ID NO:496;      EVDAAPTVDL, SEQ ID NO:497;
EVDTAPTVDL, SEQ ID NO:498;      VDAAPTVDLN, SEQ ID NO:499;
VDTAPTVDLN, SEQ ID NO:500;      DAAPTVDLNR, SEQ ID NO:501;
DAAPTVDLNQ, SEQ ID NO:502;      DTAPTVDLNR, SEQ ID NO:503;
DTAPTVDLNQ, SEQ ID NO:504;      AAPTVDLNQV, SEQ ID NO:505;
AAPTVDLNRV, SEQ ID NO:506;      TAPTVDLNQV, SEQ ID NO:507;
TAPTVDLNRV, SEQ ID NO:508;      APTVDLNQVL, SEQ ID NO:509;
APTVDLNRVL, SEQ ID NO:510;      PTVDLNQVLN, SEQ ID NO:511;
PTVDLNRVLN, SEQ ID NO:512;      TVDLNQVLNE, SEQ ID NO:513;
TVDLNRVLNE, SEQ ID NO:514;      VDLNQVLNET, SEQ ID NO:515;
VDLNRVLNET, SEQ ID NO:516;      DLNQVLNETR, SEQ ID NO:517;
DLNRVLNETR, SEQ ID NO:518;      LNQVLNETRS, SEQ ID NO:519;
LNQVLNETRN, SEQ ID NO:520;      LNRVLNETRS, SEQ ID NO:521;
LNRVLNETRN, SEQ ID NO:522;      NQVLNETRSQ, SEQ ID NO:523;
NQVLNETRNQ, SEQ ID NO:524;      NRVLNETRSQ, SEQ ID NO:525;
NRVLNETRNQ, SEQ ID NO:526;      QVLNETRSQY, SEQ ID NO:527;
QVLNETRNQY, SEQ ID NO:528;      RVLNETRSQY, SEQ ID NO:529;
RVLNETRNQY, SEQ ID NO:530;      QVLNETRSQY, SEQ ID NO:531;
QVLNETRNQY, SEQ ID NO:532;      RVLNETRSQY, SEQ ID NO:533;
RVLNETRNQY, SEQ ID NO:534;      VLNETRSQYE, SEQ ID NO:535;
VLNETRNQYE, SEQ ID NO:536;      LNETRSQYEA, SEQ ID NO:537;
LNETRNQYEA, SEQ ID NO:538;      NETRSQYEAL, SEQ ID NO:539;
NETRNQYEAL, SEQ ID NO:540;      EVNTLRCQLGD, SEQ ID NO:541;
EVNTLRCPLGD, SEQ ID NO:542;     EVNTLRSQLGD, SEQ ID NO:543;
EVNTLRSPLGD, SEQ ID NO:544;     VNTLRCQLGDR, SEQ ID NO:545;
VNTLRCPLGDR, SEQ ID NO:546;     VNTLRSQLGDR, SEQ ID NO:547;
VNTLRSPLGDR, SEQ ID NO:548;     NTLRCQLGDRL, SEQ ID NO:549;
NTLRCPLGDRL, SEQ ID NO:550;     NTLRSQLGDRL, SEQ ID NO:551;
NTLRSPLGDRL, SEQ ID NO:552;     TLRCQLGDRLN, SEQ ID NO:553;
TLRCPLGDRLN, SEQ ID NO:554;     TLRSQLGDRLN, SEQ ID NO:555;
TLRSPLGDRLN, SEQ ID NO:556;     LRCQLGDRLNV, SEQ ID NO:557;
LRCPLGDRLNV, SEQ ID NO:558;     LRSQLGDRLNV, SEQ ID NO:559;
LRSPLGDRLNV, SEQ ID NO:560;     RCQLGDRLNVE, SEQ ID NO:561;
RCPLGDRLNVE, SEQ ID NO:562;     RSQLGDRLNVE, SEQ ID NO:563;
RSPLGDRLNVE, SEQ ID NO:564;     CQLGDRLNVEV, SEQ ID NO:565;
CPLGDRLNVEV, SEQ ID NO:566;     SQLGDRLNVEV, SEQ ID NO:567;
SPLGDRLNVEV, SEQ ID NO:568;     QLGDRLNVEVD, SEQ ID NO:569;
PLGDRLNVEVD, SEQ ID NO:570;     LGDRLNVEVDA, SEQ ID NO:571;
LGDRLNVEVDT, SEQ ID NO:572;     GDRLNVEVDAA, SEQ ID NO:573;
GDRLNVEVDTA, SEQ ID NO:574;     DRLNVEVDAAP, SEQ ID NO:575;
DRLNVEVDTAP, SEQ ID NO:576;     RLNVEVDAAPT, SEQ ID NO:577;
RLNVEVDTAPT, SEQ ID NO:578;     LNVEVDAAPTV, SEQ ID NO:579;
LNVEVDTAPTV, SEQ ID NO:580;     NVEVDAAPTVD, SEQ ID NO:581;
NVEVDTAPTVD, SEQ ID NO:582;     VEVDAAPTVDL, SEQ ID NO:583;
VEVDTAPTVDL, SEQ ID NO:584;     EVDAAPTVDLN, SEQ ID NO:585;
EVDTAPTVDLN, SEQ ID NO:586;     VDAAPTVDLNQ, SEQ ID NO:587;
VDAAPTVDLNR, SEQ ID NO:588;     VDTAPTVDLNQ, SEQ ID NO:589;
VDTAPTVDLNR, SEQ ID NO:590;     DAAPTVDLNQV, SEQ ID NO:591;
DAAPTVDLNRV, SEQ ID NO:592;     DTAPTVDLNQV, SEQ ID NO:593;
DTAPTVDLNRV, SEQ ID NO:594;     AAPTVDLNQVL, SEQ ID NO:595;
AAPTVDLNRVL, SEQ ID NO:596;     TAPTVDLNQVL, SEQ ID NO:597;
TAPTVDLNRVL, SEQ ID NO:598;     APTVDLNQVLN, SEQ ID NO:599;
APTVDLNRVLN, SEQ ID NO:600;     PTVDLNQVLNE, SEQ ID NO:601;
PTVDLNRVLNE, SEQ ID NO:602;     TVDLNQVLNET, SEQ ID NO:603;
TVDLNRVLNET, SEQ ID NO:604;     VDLNQVLNETR, SEQ ID NO:605;
VDLNRVLNETR, SEQ ID NO:606;     DLNQVLNETRS, SEQ ID NO:607;
DLNQVLNETRN, SEQ ID NO:608;     DLNRVLNETRS, SEQ ID NO:609;
DLNRVLNETRN, SEQ ID NO:610;     LNQVLNETRSQ, SEQ ID NO:611;
LNQVLNETRNQ, SEQ ID NO:612;     LNRVLNETRSQ, SEQ ID NO:613;
LNRVLNETRNQ, SEQ ID NO:614;     NQVLNETRSQY, SEQ ID NO:615;
NQVLNETRNQY, SEQ ID NO:616;     NRVLNETRSQY, SEQ ID NO:617;
NRVLNETRNQY, SEQ ID NO:618;     QVLNETRSQYE, SEQ ID NO:619;
QVLNETRNQYE, SEQ ID NO:620;     RVLNETRSQYE, SEQ ID NO:621;
RVLNETRNQYE, SEQ ID NO:622;     VLNETRSQYEA, SEQ ID NO:623;
```

-continued

```
VLNETRNQYEA, SEQ ID NO:624;        LNETRSQYEAL, SEQ ID NO:625;
LNETRNQYEAL, SEQ ID NO:626;        EVNTLRCQLGDR, SEQ ID NO:627;
EVNTLRCPLGDR, SEQ ID NO:628;       EVNTLRSQLGDR, SEQ ID NO:629;
EVNTLRSPLGDR, SEQ ID NO:630;       VNTLRCQLGDRL, SEQ ID NO:631;
VNTLRCPLGDRL, SEQ ID NO:632;       VNTLRSQLGDRL, SEQ ID NO:633;
VNTLRSPLGDRL, SEQ ID NO:634;       NTLRCQLGDRLN, SEQ ID NO:635;
NTLRCPLGDRLN, SEQ ID NO:636;       NTLRSQLGDRLN, SEQ ID NO:637;
NTLRSPLGDRLN, SEQ ID NO:638;       TLRCQLGDRLNV, SEQ ID NO:639;
TLRCPLGDRLNV, SEQ ID NO:640;       TLRSQLGDRLNV, SEQ ID NO:641;
TLRSPLGDRLNV, SEQ ID NO:642;       LRCQLGDRLNVE, SEQ ID NO:643;
LRCPLGDRLNVE, SEQ ID NO:644;       LRSQLGDRLNVE, SEQ ID NO:645;
LRSPLGDRLNVE, SEQ ID NO:646;       RCQLGDRLNVEV, SEQ ID NO:647;
RCPLGDRLNVEV, SEQ ID NO:648;       RSQLGDRLNVEV, SEQ ID NO:649;
RSPLGDRLNVEV, SEQ ID NO:650;       CQLGDRLNVEVD, SEQ ID NO:651;
CPLGDRLNVEVD, SEQ ID NO:652;       SQLGDRLNVEVD, SEQ ID NO:653;
SPLGDRLNVEVD, SEQ ID NO:654;       QLGDRLNVEVDA, SEQ ID NO:655;
QLGDRLNVEVDT, SEQ ID NO:656;       PLGDRLNVEVDA, SEQ ID NO:657;
PLGDRLNVEVDT, SEQ ID NO:658;       LGDRLNVEVDAA, SEQ ID NO:659;
LGDRLNVEVDTA, SEQ ID NO:660;       GDRLNVEVDAAP, SEQ ID NO:661;
GDRLNVEVDTAP, SEQ ID NO:662;       DRLNVEVDAAPT, SEQ ID NO:663;
DRLNVEVDTAPT, SEQ ID NO:664;       RLNVEVDAAPTV, SEQ ID NO:665;
RLNVEVDTAPTV, SEQ ID NO:666;       LNVEVDAAPTVD, SEQ ID NO:667;
LNVEVDTAPTVD, SEQ ID NO:668;       NVEVDAAPTVDL, SEQ ID NO:669;
NVEVDTAPTVDL, SEQ ID NO:670;       VEVDAAPTVDLN, SEQ ID NO:671;
VEVDTAPTVDLN, SEQ ID NO:672;       EVDAAPTVDLNQ, SEQ ID NO:673;
EVDAAPTVDLNR, SEQ ID NO:674;       EVDTAPTVDLNQ, SEQ ID NO:675;
EVDTAPTVDLNR, SEQ ID NO:676;       VDAAPTVDLNQV, SEQ ID NO:677;
VDAAPTVDLNRV, SEQ ID NO:678;       VDTAPTVDLNQV, SEQ ID NO:679;
VDTAPTVDLNRV, SEQ ID NO:680;       DAAPTVDLNQVL, SEQ ID NO:681;
DAAPTVDLNRVL, SEQ ID NO:682;       DTAPTVDLNQVL, SEQ ID NO:683;
DTAPTVDLNRVL, SEQ ID NO:684;       AAPTVDLNQVLN, SEQ ID NO:685;
AAPTVDLNRVLN, SEQ ID NO:686;       TAPTVDLNQVLN, SEQ ID NO:687;
TAPTVDLNRVLN, SEQ ID NO:688;       APTVDLNQVLNE, SEQ ID NO:689;
APTVDLNRVLNE, SEQ ID NO:690;       PTVDLNQVLNET, SEQ ID NO:691;
PTVDLNRVLNET, SEQ ID NO:692;       TVDLNQVLNETR, SEQ ID NO:693;
TVDLNRVLNETR, SEQ ID NO:694;       VDLNQVLNETRS, SEQ ID NO:695;
VDLNQVLNETRN, SEQ ID NO:696;       VDLNRVLNETRS, SEQ ID NO:697;
VDLNRVLNETRN, SEQ ID NO:698;       DLNQVLNETRSQ, SEQ ID NO:699;
DLNQVLNETRNQ, SEQ ID NO:700;       DLNRVLNETRSQ, SEQ ID NO:701;
DLNRVLNETRNQ, SEQ ID NO:702;       LNQVLNETRSQY, SEQ ID NO:703;
LNQVLNETRNQY, SEQ ID NO:704;       LNRVLNETRSQY, SEQ ID NO:705;
LNRVLNETRNQY, SEQ ID NO:706;       NQVLNETRSQYE, SEQ ID NO:707;
LNQVLNETRNQY, SEQ ID NO:708;       LNRVLNETRSQY, SEQ ID NO:709;
LNRVLNETRNQY, SEQ ID NO:710;       QVLNETRSQYEA, SEQ ID NO:711;
QVLNETRNQYEA, SEQ ID NO:712;       RVLNETRSQYEA, SEQ ID NO:713;
RVLNETRNQYEA, SEQ ID NO:714;       VLNETRSQYEAL, SEQ ID NO:715;
VLNETRNQYEAL, SEQ ID NO:716;       EVNTLRCQLGDRL, SEQ ID NO:717;
EVNTLRCPLGDRL, SEQ ID NO:718;      EVNTLRSQLGDRL, SEQ ID NO:719;
EVNTLRSPLGDRL, SEQ ID NO:720;      VNTLRCQLGDRLN, SEQ ID NO:721;
VNTLRCPLGDRLN, SEQ ID NO:722;      VNTLRSQLGDRLN, SEQ ID NO:723;
VNTLRSPLGDRLN, SEQ ID NO:724;      NTLRCQLGDRLNV, SEQ ID NO:725;
NTLRCPLGDRLNV, SEQ ID NO:726;      NTLRSQLGDRLNV, SEQ ID NO:727;
NTLRSPLGDRLNV, SEQ ID NO:728;      TLRCQLGDRLNVE, SEQ ID NO:729;
TLRCPLGDRLNVE, SEQ ID NO:730;      TLRSQLGDRLNVE, SEQ ID NO:731;
TLRSPLGDRLNVE, SEQ ID NO:732;      LRCQLGDRLNVEV, SEQ ID NO:733;
LRCPLGDRLNVEV, SEQ ID NO:734;      LRSQLGDRLNVEV, SEQ ID NO:735;
LRSPLGDRLNVEV, SEQ ID NO:736;      RCQLGDRLNVEVD, SEQ ID NO:737;
RCPLGDRLNVEVD, SEQ ID NO:738;      RSQLGDRLNVEVD, SEQ ID NO:739;
RSPLGDRLNVEVD, SEQ ID NO:740;      CQLGDRLNVEVDA, SEQ ID NO:741;
CQLGDRLNVEVDT, SEQ ID NO:742;      CPLGDRLNVEVDA, SEQ ID NO:743;
CPLGDRLNVEVDT, SEQ ID NO:744;      SQLGDRLNVEVDA, SEQ ID NO:745;
SQLGDRLNVEVDT, SEQ ID NO:746;      SPLGDRLNVEVDA, SEQ ID NO:747;
SPLGDRLNVEVDT, SEQ ID NO:748;      QLGDRLNVEVDAA, SEQ ID NO:749;
QLGDRLNVEVDTA, SEQ ID NO:750;      PLGDRLNVEVDAA, SEQ ID NO:751;
PLGDRLNVEVDTA, SEQ ID NO:752;      LGDRLNVEVDAAP, SEQ ID NO:753;
LGDRLNVEVDTAP, SEQ ID NO:754;      GDRLNVEVDAAPT, SEQ ID NO:755;
GDRLNVEVDTAPT, SEQ ID NO:756;      DRLNVEVDAAPTV, SEQ ID NO:757;
DRLNVEVDTAPTV, SEQ ID NO:758;      RLNVEVDAAPTVD, SEQ ID NO:759;
RLNVEVDTAPTVD, SEQ ID NO:760;      LNVEVDAAPTVDL, SEQ ID NO:761;
LNVEVDTAPTVDL, SEQ ID NO:762;      NVEVDAAPTVDLN, SEQ ID NO:763;
NVEVDTAPTVDLN, SEQ ID NO:764;      VEVDAAPTVDLNQ, SEQ ID NO:765;
VEVDAAPTVDLNR, SEQ ID NO:766;      VEVDTAPTVDLNQ, SEQ ID NO:767;
VEVDTAPTVDLNR, SEQ ID NO:768;      EVDAAPTVDLNQV, SEQ ID NO:769;
EVDAAPTVDLNRV, SEQ ID NO:770;      EVDTAPTVDLNQV, SEQ ID NO:771;
EVDTAPTVDLNRV, SEQ ID NO:772;      VDAAPTVDLNQVL, SEQ ID NO:773;
VDAAPTVDLNRVL, SEQ ID NO:774;      VDTAPTVDLNQVL, SEQ ID NO:775;
VDTAPTVDLNRVL, SEQ ID NO:776;      DAAPTVDLNQVLN, SEQ ID NO:777;
DAAPTVDLNRVLN, SEQ ID NO:778;      DTAPTVDLNQVLN, SEQ ID NO:779;
DTAPTVDLNRVLN, SEQ ID NO:780;      AAPTVDLNQVLNE, SEQ ID NO:781;
AAPTVDLNRVLNE, SEQ ID NO:782;      TAPTVDLNQVLNE, SEQ ID NO:783;
```

-continued

```
TAPTVDLNRVLNE,   SEQ ID NO:784;    APTVDLNQVLNET,   SEQ ID NO:785;
APTVDLNRVLNET,   SEQ ID NO:786;    PTVDLNQVLNETR,   SEQ ID NO:787;
PTVDLNRVLNETR,   SEQ ID NO:788;    TVDLNQVLNETRS,   SEQ ID NO:789;
TVDLNQVLNETRN,   SEQ ID NO:790;    TVDLNRVLNETRS,   SEQ ID NO:791;
TVDLNRVLNETRN,   SEQ ID NO:792;    VDLNQVLNETRSQ,   SEQ ID NO:793;
VDLNQVLNETRNQ,   SEQ ID NO:794;    VDLNRVLNETRSQ,   SEQ ID NO:795;
VDLNRVLNETRNQ,   SEQ ID NO:796;    DLNQVLNETRSQY,   SEQ ID NO:797;
DLNQVLNETRNQY,   SEQ ID NO:798;    DLNRVLNETRSQY,   SEQ ID NO:799;
DLNRVLNETRNQY,   SEQ ID NO:800;    LNQVLNETRSQYE,   SEQ ID NO:801;
LNQVLNETRNQYE,   SEQ ID NO:802;    LNRVLNETRSQYE,   SEQ ID NO:803;
LNRVLNETRNQYE,   SEQ ID NO:804;    NQVLNETRSQYEA,   SEQ ID NO:805;
NQVLNETRNQYEA,   SEQ ID NO:806;    NRVLNETRSQYEA,   SEQ ID NO:807;
NRVLNETRNQYEA,   SEQ ID NO:808;    QVLNETRSQYEAL,   SEQ ID NO:809;
QVLNETRNQYEAL,   SEQ ID NO:810;    RVLNETRSQYEAL,   SEQ ID NO:811;
RVLNETRNQYEAL,   SEQ ID NO:812;    EVNTLRCQLGDRLN,  SEQ ID NO:813;
EVNTLRCPLGDRLN,  SEQ ID NO:814;    EVNTLRSQLGDRLN,  SEQ ID NO:815;
EVNTLRSPLGDRLN,  SEQ ID NO:816;    VNTLRCQLGDRLNV,  SEQ ID NO:817;
VNTLRCPLGDRLNV,  SEQ ID NO:818;    VNTLRSQLGDRLNV,  SEQ ID NO:819;
VNTLRSPLGDRLNV,  SEQ ID NO:820;    NTLRCQLGDRLNVE,  SEQ ID NO:821;
NTLRCPLGDRLNVE,  SEQ ID NO:822;    NTLRSQLGDRLNVE,  SEQ ID NO:823;
NTLRSPLGDRLNVE,  SEQ ID NO:824;    TLRCQLGDRLNVEV,  SEQ ID NO:825;
TLRCPLGDRLNVEV,  SEQ ID NO:826;    TLRSQLGDRLNVEV,  SEQ ID NO:827;
TLRSPLGDRLNVEV,  SEQ ID NO:828;    LRCQLGDRLNVEVD,  SEQ ID NO:829;
LRCPLGDRLNVEVD,  SEQ ID NO:830;    LRSQLGDRLNVEVD,  SEQ ID NO:831;
LRSPLGDRLNVEVD,  SEQ ID NO:832;    RCQLGDRLNVEVDA,  SEQ ID NO:833;
RCQLGDRLNVEVDT,  SEQ ID NO:834;    RCPLGDRLNVEVDA,  SEQ ID NO:835;
RCPLGDRLNVEVDT,  SEQ ID NO:836;    RSQLGDRLNVEVDA,  SEQ ID NO:837;
RSQLGDRLNVEVDT,  SEQ ID NO:838;    RSPLGDRLNVEVDA,  SEQ ID NO:839;
RSPLGDRLNVEVDT,  SEQ ID NO:840;    CQLGDRLNVEVDAA,  SEQ ID NO:841;
CQLGDRLNVEVDTA,  SEQ ID NO:842;    CPLGDRLNVEVDAA,  SEQ ID NO:843;
CPLGDRLNVEVDTA,  SEQ ID NO:844;    SQLGDRLNVEVDAA,  SEQ ID NO:845;
SQLGDRLNVEVDTA,  SEQ ID NO:846;    SPLGDRLNVEVDAA,  SEQ ID NO:847;
SPLGDRLNVEVDTA,  SEQ ID NO:848;    QLGDRLNVEVDAAP,  SEQ ID NO:849;
QLGDRLNVEVDTAP,  SEQ ID NO:850;    PLGDRLNVEVDAAP,  SEQ ID NO:851;
PLGDRLNVEVDTAP,  SEQ ID NO:852;    LGDRLNVEVDAAPT,  SEQ ID NO:853;
LGDRLNVEVDTAPT,  SEQ ID NO:854;    GDRLNVEVDAAPTV,  SEQ ID NO:855;
GDRLNVEVDTAPTV,  SEQ ID NO:856;    DRLNVEVDAAPTVD,  SEQ ID NO:857;
DRLNVEVDTAPTVD,  SEQ ID NO:858;    RLNVEVDAAPTVDL,  SEQ ID NO:859;
RLNVEVDTAPTVDL,  SEQ ID NO:860;    LNVEVDAAPTVDLN,  SEQ ID NO:861;
LNVEVDTAPTVDLN,  SEQ ID NO:862;    NVEVDAAPTVDLNQ,  SEQ ID NO:863;
NVEVDAAPTVDLNR,  SEQ ID NO:864;    NVEVDTAPTVDLNQ,  SEQ ID NO:865;
NVEVDTAPTVDLNR,  SEQ ID NO:866;    VEVDAAPTVDLNQV,  SEQ ID NO:867;
VEVDAAPTVDLNRV,  SEQ ID NO:868;    VEVDTAPTVDLNQV,  SEQ ID NO:869;
VEVDTAPTVDLNRV,  SEQ ID NO:870;    EVDAAPTVDLNQVL,  SEQ ID NO:871;
EVDAAPTVDLNRVL,  SEQ ID NO:872;    EVDTAPTVDLNQVL,  SEQ ID NO:873;
EVDTAPTVDLNRVL,  SEQ ID NO:874;    VDAAPTVDLNQVLN,  SEQ ID NO:875;
VDAAPTVDLNRVLN,  SEQ ID NO:876;    VDTAPTVDLNQVLN,  SEQ ID NO:877;
VDTAPTVDLNRVLN,  SEQ ID NO:878;    DAAPTVDLNQVLNE,  SEQ ID NO:879;
DAAPTVDLNRVLNE,  SEQ ID NO:880;    DTAPTVDLNQVLNE,  SEQ ID NO:881;
DTAPTVDLNRVLNE,  SEQ ID NO:882;    AAPTVDLNQVLNET,  SEQ ID NO:883;
AAPTVDLNRVLNET,  SEQ ID NO:884;    TAPTVDLNQVLNET,  SEQ ID NO:885;
TAPTVDLNRVLNET,  SEQ ID NO:886;    APTVDLNQVLNETR,  SEQ ID NO:887;
APTVDLNRVLNETR,  SEQ ID NO:888;    PTVDLNQVLNETRS,  SEQ ID NO:889;
PTVDLNQVLNETRN,  SEQ ID NO:890;    PTVDLNRVLNETRS,  SEQ ID NO:891;
PTVDLNRVLNETRN,  SEQ ID NO:892;    TVDLNQVLNETRSQ,  SEQ ID NO:893;
TVDLNQVLNETRNQ,  SEQ ID NO:894;    TVDLNRVLNETRSQ,  SEQ ID NO:895;
TVDLNRVLNETRNQ,  SEQ ID NO:896;    VDLNQVLNETRSQY,  SEQ ID NO:897;
VDLNQVLNETRNQY,  SEQ ID NO:898;    VDLNRVLNETRSQY,  SEQ ID NO:899;
VDLNRVLNETRNQY,  SEQ ID NO:900;    DLNQVLNETRSQYE,  SEQ ID NO:901;
DLNQVLNETRNQYE,  SEQ ID NO:902;    DLNRVLNETRSQYE,  SEQ ID NO:903;
DLNRVLNETRNQYE,  SEQ ID NO:904;    LNQVLNETRSQYEA,  SEQ ID NO:905;
LNQVLNETRNQYEA,  SEQ ID NO:906;    LNRVLNETRSQYEA,  SEQ ID NO:907;
LNRVLNETRNQYEA,  SEQ ID NO:908;    NQVLNETRSQYEAL,  SEQ ID NO:909;
NQVLNETRNQYEAL,  SEQ ID NO:910;    NRVLNETRSQYEAL,  SEQ ID NO:911;
NRVLNETRNQYEAL,  SEQ ID NO:912;    EVNTLRCQLGDRLNV, SEQ ID NO:913;
EVNTLRCPLGDRLNV, SEQ ID NO:914;    EVNTLRSQLGDRLNV, SEQ ID NO:915;
EVNTLRSPLGDRLNV, SEQ ID NO:916;    VNTLRCQLGDRLNVE, SEQ ID NO:917;
VNTLRCPLGDRLNVE, SEQ ID NO:918;    VNTLRSQLGDRLNVE, SEQ ID NO:919;
VNTLRSPLGDRLNVE, SEQ ID NO:920;    NTLRCQLGDRLNVEV, SEQ ID NO:921;
NTLRCPLGDRLNVEV, SEQ ID NO:922;    NTLRSQLGDRLNVEV, SEQ ID NO:923;
NTLRSPLGDRLNVEV, SEQ ID NO:924;    TLRCQLGDRLNVEVD, SEQ ID NO:925;
TLRCPLGDRLNVEVD, SEQ ID NO:926;    TLRSQLGDRLNVEVD, SEQ ID NO:927;
TLRSPLGDRLNVEVD, SEQ ID NO:928;    LRCQLGDRLNVEVDA, SEQ ID NO:929;
LRCQLGDRLNVEVDT, SEQ ID NO:930;    LRCPLGDRLNVEVDA, SEQ ID NO:931;
LRCPLGDRLNVEVDT, SEQ ID NO:932;    LRSQLGDRLNVEVDA, SEQ ID NO:933;
LRSQLGDRLNVEVDT, SEQ ID NO:934;    LRSPLGDRLNVEVDA, SEQ ID NO:935;
LRSPLGDRLNVEVDT, SEQ ID NO:936;    RCQLGDRLNVEVDAA, SEQ ID NO:937;
RCQLGDRLNVEVDTA, SEQ ID NO:938;    RCPLGDRLNVEVDAA, SEQ ID NO:939;
RCPLGDRLNVEVDTA, SEQ ID NO:940;    RSQLGDRLNVEVDAA, SEQ ID NO:941;
RSQLGDRLNVEVDTA, SEQ ID NO:942;    RSPLGDRLNVEVDAA, SEQ ID NO:943;
```

-continued

```
RSPLGDRLNVEVDTA,   SEQ ID NO:944;      CQLGDRLNVEVDAAP,   SEQ ID NO:945;
CQLGDRLNVEVDTAP,   SEQ ID NO:946;      CPLGDRLNVEVDANP,   SEQ ID NO:947;
CPLGDRLNVEVDTAP,   SEQ ID NO:948;      SQLGDRLNVEVDAAP,   SEQ ID NO:949;
SQLGDRLNVEVDTAP,   SEQ ID NO:950;      SPLGDRLNVEVDAAP,   SEQ ID NO:951;
SPLGDRLNVEVDTAP,   SEQ ID NO:952;      QLGDRLNVEVDANPT,   SEQ ID NO:953;
QLGDRLNVEVDTAPT,   SEQ ID NO:954;      PLGDRLNVEVDAAPT,   SEQ ID NO:955;
PLGDRLNVEVDTAPT,   SEQ ID NO:956;      LGDRLNVEVDAAPTV,   SEQ ID NO:957;
LGDRLNVEVDTAPTV,   SEQ ID NO:958;      GDRLNVEVDAAPTVD,   SEQ ID NO:959;
GDRLNVEVDTAPTVD,   SEQ ID NO:960;      DRLNVEVDAAPTVDL,   SEQ ID NO:961;
DRLNVEVDTAPTVDL,   SEQ ID NO:962;      RLNVEVDAAPTVDLN,   SEQ ID NO:963;
RLNVEVDTAPTVDLN,   SEQ ID NO:964;      LNVEVDAAPTVDLNQ,   SEQ ID NO:965;
LNVEVDANPTVDLNR,   SEQ ID NO:966;      LNVEVDTAPTVDLNQ,   SEQ ID NO:967;
LNVEVDTAPTVDLNR,   SEQ ID NO:968;      NVEVDAAPTVDLNQV,   SEQ ID NO:969;
NVEVDAAPTVDLNRV,   SEQ ID NO:970;      NVEVDTAPTVDLNQV,   SEQ ID NO:971;
NVEVDTAPTVDLNRV,   SEQ ID NO:972;      VEVDAAPTVDLNQVL,   SEQ ID NO:973;
VEVDAAPTVDLNRVL,   SEQ ID NO:974;      VEVDTAPTVDLNQVL,   SEQ ID NO:975;
VEVDTAPTVDLNRVL,   SEQ ID NO:976;      EVDAAPTVDLNQVLN,   SEQ ID NO:977;
EVDAAPTVDLNRVLN,   SEQ ID NO:978;      EVDTAPTVDLNQVLN,   SEQ ID NO:979;
EVDTAPTVDLNRVLN,   SEQ ID NO:980;      VDAAPTVDLNQVLNE,   SEQ ID NO:981;
VDAAPTVDLNRVLNE,   SEQ ID NO:982;      VDTAPTVDLNQVLNE,   SEQ ID NO:983;
VDTAPTVDLNRVLNE,   SEQ ID NO:984;      DAAPTVDLNQVLNET,   SEQ ID NO:985;
DAAPTVDLNRVLNET,   SEQ ID NO:986;      DTAPTVDLNQVLNET,   SEQ ID NO:987;
DTAPTVDLNRVLNET,   SEQ ID NO:988;      AAPTVDLNQVLNETR,   SEQ ID NO:989;
AAPTVDLNRVLNETR,   SEQ ID NO:990;      TAPTVDLNQVLNETR,   SEQ ID 140:991;
TAPTVDLNRVLNETR,   SEQ ID NO:992;      APTVDLNQVLNETRS,   SEQ ID 140:993;
APTVDLNQVLNETRN,   SEQ ID NO:994;      APTVDLNRVLNETRS,   SEQ ID NO:995;
APTVDLNRVLNETRN,   SEQ ID NO:996;      PTVDLNQVLNETRSQ,   SEQ ID NO:997;
PTVDLNQVLNETRNQ,   SEQ ID NO:998;      PTVDLNRVLNETRSQ,   SEQ ID NO:999;
PTVDLNRVLNETRNQ,   SEQ ID NO:1000;
                                       TVDLNQVLNETRNQY,   SEQ ID NO:1002;
TVDLNQVLNETRSQY,   SEQ ID NO:1001;
TVDLNRVLNETRSQY,   SEQ ID NO:1003;     TVDLNRVLNETRNQY,   SEQ ID NO:1004;
VDLNQVLNETRSQYE,   SEQ ID NO:1005;     VDLNQVLNETRNQYE,   SEQ ID NO:1006;
VDLNRVLNETRSQYE,   SEQ ID NO:1007;     VDLNRVLNETRNQYE,   SEQ ID NO:1008;
DLNQVLNETRSQYEA,   SEQ ID NO:1009;     DLNQVLNETRNQYEA,   SEQ ID NO:1110;
DLNRVLNETRSQYEA,   SEQ ID NO:1111;     DLNRVLNETRNQYEA,   SEQ ID NO:1112;
LNQVLNETRSQYEAL,   SEQ ID NO:1113;     LNQVLNETRNQYEAL,   SEQ ID NO:1114;
LNRVLNETRSQYEAL,   SEQ ID NO:1115;     LNRVLNETRNQYEAL,   SEQ ID NO:1116;
EVNTLRCQLGDRLNVE,  SEQ ID NO:1117;     EVNTLRCPLGDRLNVE,  SEQ ID NO:1118;
EVNTLRSQLGDRLNVE,  SEQ ID NO:1119;     EVNTLRSPLGDRLNVE,  SEQ ID NO:1120;
VNTLRCQLGDRLNVEV,  SEQ ID NO:1121;     VNTLRCPLGDRLNVEV,  SEQ ID NO:1122;
VNTLRSQLGDRLNVEV,  SEQ ID NO:1123;     VNTLRSPLGDRLNVEV,  SEQ ID NO:1124;
NTLRCQLGDRLNVEVD,  SEQ ID NO:1125;     NTLRCPLGDRLNVEVD,  SEQ ID NO:1126;
NTLRSQLGDRLNVEVD,  SEQ ID NO:1127;     NTLRSPLGDRLNVEVD,  SEQ ID NO:1128;
TLRCQLGDRLNVEVDA,  SEQ ID NO:1129;     TLRCQLGDRLNVEVDT,  SEQ ID NO:1130;
TLRCPLGDRLNVEVDA,  SEQ ID NO:1131;     TLRCPLGDRLNVEVDT,  SEQ ID NO:1132;
TLRSQLGDRLNVEVDA,  SEQ ID NO:1133;     TLRSQLGDRLNVEVDT,  SEQ ID NO:1134;
TLRSPLGDRLNVEVDA,  SEQ ID NO:1135;     TLRSPLGDRLNVEVDT,  SEQ ID NO:1136;
LRCQLGDRLNVEVDAA,  SEQ ID NO:1137;     LRCQLGDRLNVEVDTA,  SEQ ID NO:1138;
LRCPLGDRLNVEVDAA,  SEQ ID NO:1139;     LRCPLGDRLNVEVDTA,  SEQ ID NO:1140;
LRSQLGDRLNVEVDAA,  SEQ ID NO:1141;     LRSQLGDRLNVEVDTA,  SEQ ID NO:1142;
LRSPLGDRLNVEVDAA,  SEQ ID NO:1143;     LRSPLGDRLNVEVDTA,  SEQ ID NO:1144;
RCQLGDRLNVEVDAAP,  SEQ ID NO:1145;     RCQLGDRLNVEVDTAP,  SEQ ID NO:1146;
RCPLGDRLNVEVDAAP,  SEQ ID NO:1147;     RCPLGDRLNVEVDTAP,  SEQ ID NO:1148;
RSQLGDRLNVEVDAAP,  SEQ ID NO:1149;     RSQLGDRLNVEVDTAP,  SEQ ID NO:1150;
RSPLGDRLNVEVDAAP,  SEQ ID NO:1151;     RSPLGDRLNVEVDTAP,  SEQ ID NO:1152;
CQLGDRLNVEVDAAPT,  SEQ ID NO:1153;     CQLGDRLNVEVDTAPT,  SEQ ID NO:1154;
CPLGDRLNVEVDAAPT,  SEQ ID NO:1155;     CPLGDRLNVEVDTAPT,  SEQ ID NO:1156;
SQLGDRLNVEVDAAPT,  SEQ ID NO:1157;     SQLGDRLNVEVDTAPT,  SEQ ID NO:1158;
SPLGDRLNVEVDAAPT,  SEQ ID NO:1159;     SPLGDRLNVEVDTAPT,  SEQ ID NO:1160;
QLGDRLNVEVDAAPTV,  SEQ ID NO:1161;     QLGDRLNVEVDTAPTV,  SEQ ID NO:1162;
PLGDRLNVEVDAAPTV,  SEQ ID NO:1163;     PLGDRLNVEVDTAPTV,  SEQ ID NO:1164;
LGDRLNVEVDAAPTVD,  SEQ ID NO:1165;     LGDRLNVEVDTAPTVD,  SEQ ID NO:1166;
GDRLNVEVDAAPTVDL,  SEQ ID NO:1167;     GDRLNVEVDTAPTVDL,  SEQ ID NO:1168;
DRLNVEVDAAPTVDLN,  SEQ ID NO:1169;     DRLNVEVDTAPTVDLN,  SEQ ID NO:1170;
RLNVEVDAAPTVDLNQ,  SEQ ID NO:1171;     RLNVEVDAAPTVDLNR,  SEQ ID NO:1172;
RLNVEVDTAPTVDLNQ,  SEQ ID NO:1173;     RLNVEVDTAPTVDLNR,  SEQ ID NO:1174;
LNVEVDAAPTVDLNQV,  SEQ ID NO:1175;     LNVEVDAAPTVDLNRV,  SEQ ID NO:1176;
LNVEVDTAPTVDLNQV,  SEQ ID NO:1177;     LNVEVDTAPTVDLNRV,  SEQ ID NO:1178;
NVEVDAAPTVDLNQVL,  SEQ ID NO:1179;     NVEVDAAPTVDLNRVL,  SEQ ID NO:1180;
NVEVDTAPTVDLNQVL,  SEQ ID NO:1181;     NVEVDTAPTVDLNRVL,  SEQ ID NO:1182;
VEVDAAPTVDLNQVLN,  SEQ ID NO:1183;     VEVDAAPTVDLNRVLN,  SEQ ID NO:1184;
VEVDTAPTVDLNQVLN,  SEQ ID NO:1185;     VEVDTAPTVDLNRVLN,  SEQ ID NO:1186;
EVDAAPTVDLNQVLNE,  SEQ ID NO:1187;     EVDAAPTVDLNRVLNE,  SEQ ID NO:1188;
EVDTAPTVDLNQVLNE,  SEQ ID NO:1189;     EVDTAPTVDLNRVLNE,  SEQ ID NO:1190;
VDAAPTVDLNQVLNET,  SEQ ID NO:1191;     VDAAPTVDLNRVLNET,  SEQ ID NO:1192;
VDTAPTVDLNQVLNET,  SEQ ID NO:1193;     VDTAPTVDLNRVLNET,  SEQ ID NO:1194;
DAAPTVDLNQVLNETR,  SEQ ID NO:1195;     DAAPTVDLNRVLNETR,  SEQ ID NO:1196;
DTAPTVDLNQVLNETR,  SEQ ID NO:1197;     DTAPTVDLNRVLNETR,  SEQ ID NO:1198;
AAPTVDLNQVLNETRS,  SEQ ID NO:1199;     AAPTVDLNQVLNETRN,  SEQ ID NO:1200;
AAPTVDLNRVLNETRS,  SEQ ID NO:1201;     AAPTVDLNRVLNETRN,  SEQ ID NO:1202;
```

-continued

| | |
|---|---|
| TAPTVDLNQVLNETRS, SEQ ID NO:1203; | TAPTVDLNQVLNETRN, SEQ ID NO:1204; |
| TAPTVDLNRVLNETRS, SEQ ID NO:1205; | TAPTVDLNRVLNETRN, SEQ ID NO:1206; |
| APTVDLNQVLNETRSQ, SEQ ID NO:1207; | APTVDLNQVLNETRNQ, SEQ ID NO:1208; |
| APTVDLNRVLNETRSQ, SEQ ID NO:1209; | APTVDLNRVLNETRNQ, SEQ ID NO:1210; |
| PTVDLNQVLNETRSQY, SEQ ID NO:1211; | PTVDLNQVLNETRNQY, SEQ ID NO:1212; |
| PTVDLNRVLNETRSQY, SEQ ID NO:1213; | PTVDLNRVLNETRNQY, SEQ ID NO:1214; |
| TVDLNQVLNETRSQYE, SEQ ID NO:1215; | TVDLNQVLNETRNQYE, SEQ ID NO:1216; |
| TVDLNRVLNETRSQYE, SEQ ID NO:1217; | TVDLNRVLNETRNQYE, SEQ ID NO:1218; |
| VDLNQVLNETRSQYEA, SEQ ID NO:1219; | VDLNQVLNETRNQYEA, SEQ ID NO:1220; |
| VDLNRVLNETRSQYEA, SEQ ID NO:1221; | VDLNRVLNETRNQYEA, SEQ ID NO:1222; |
| DLNQVLNETRSQYEAL, SEQ ID NO:1223; | DLNQVLNETRNQYEAL, SEQ ID NO:1224; |
| DLNRVLNETRSQYEAL, SEQ ID NO:1225; | DLNRVLNETRNQYEAL, SEQ ID NO:1226; |
| EVNTLRCQLGDRLNVEV, SEQ ID NO:1227; | EVNTLRCPLGDRLNVEV, SEQ ID NO:1228; |
| EVNTLRSQLGDRLNVEV, SEQ ID NO:1229; | EVNTLRSPLGDRLNVEV, SEQ ID NO:1230; |
| VNTLRCQLGDRLNVEVD, SEQ ID NO:1231; | VNTLRCPLGDRLNVEVD, SEQ ID NO:1232; |
| VNTLRSQLGDRLNVEVD, SEQ ID NO:1233; | VNTLRSPLGDRLNVEVD, SEQ ID NO:1234; |
| NTLRCQLGDRLNVEVDA, SEQ ID NO:1235; | NTLRCQLGDRLNVEVDT, SEQ ID NO:1236; |
| NTLRCPLGDRLNVEVDA, SEQ ID NO:1237; | NTLRCPLGDRLNVEVDT, SEQ ID NO:1238; |
| NTLRSQLGDRLNVEVDA, SEQ ID NO:1239; | NTLRSQLGDRLNVEVDT, SEQ ID NO:1240; |
| NTLRSPLGDRLNVEVDA, SEQ ID NO:1241; | NTLRSPLGDRLNVEVDT, SEQ ID NO:1242; |
| TLRCQLGDRLNVEVDAA, SEQ ID NO:1243; | TLRCQLGDRLNVEVDTA, SEQ ID NO:1244; |
| TLRCPLGDRLNVEVDAA, SEQ ID NO:1245; | TLRCPLGDRLNVEVDTA, SEQ ID NO:1246; |
| TLRSQLGDRLNVEVDAA, SEQ ID NO:1247; | TLRSQLGDRLNVEVDTA, SEQ ID NO:1248; |
| TLRSPLGDRLNVEVDAA, SEQ ID NO:1249; | TLRSPLGDRLNVEVDTA, SEQ ID NO:1250; |
| LRCQLGDRLNVEVDAAP, SEQ ID NO:1251; | LRCQLGDRLNVEVDTAP, SEQ ID NO:1252; |
| LRCPLGDRLNVEVDAAP, SEQ ID NO:1253; | LRCPLGDRLNVEVDTAP, SEQ ID NO:1254; |
| LRSQLGDRLNVEVDAAP, SEQ ID NO:1255; | LRSQLGDRLNVEVDTAP, SEQ ID NO:1256; |
| LRSPLGDRLNVEVDAAP, SEQ ID NO:1257; | LRSPLGDRLNVEVDTAP, SEQ ID NO:1258; |
| RCQLGDRLNVEVDAAPT, SEQ ID NO:1259; | RCQLGDRLNVEVDTAPT, SEQ ID NO:1260; |
| RCPLGDRLNVEVDAAPT, SEQ ID NO:1261; | RCPLGDRLNVEVDTAPT, SEQ ID NO:1262; |
| RSQLGDRLNVEVDAAPT, SEQ ID NO:1263; | RSQLGDRLNVEVDTAPT, SEQ ID NO:1264; |
| RSPLGDRLNVEVDAAPT, SEQ ID NO:1265; | RSPLGDRLNVEVDTAPT, SEQ ID NO:1266; |
| CQLGDRLNVEVDAAPTV, SEQ ID NO:1267; | CQLGDRLNVEVDTAPTV, SEQ ID NO:1268; |
| CPLGDRLNVEVDAAPTV, SEQ ID NO:1269; | CPLGDRLNVEVDTAPTV, SEQ ID NO:1270; |
| SQLGDRLNVEVDAAPTV, SEQ ID NO:1271; | SQLGDRLNVEVDTAPTV, SEQ ID NO:1272; |
| SPLGDRLNVEVDAAPTV, SEQ ID NO:1273; | SPLGDRLNVEVDTAPTV, SEQ ID NO:1274; |
| QLGDRLNVEVDAAPTVD, SEQ ID NO:1275; | QLGDRLNVEVDTAPTVD, SEQ ID NO:1276; |
| PLGDRLNVEVDAAPTVD, SEQ ID NO:1277; | PLGDRLNVEVDTAPTVD, SEQ ID NO:1278; |
| LGDRLNVEVDAAPTVDL, SEQ ID NO:1279; | LGDRLNVEVDTAPTVDL, SEQ ID NO:1280; |
| GDRLNVEVDAAPTVDLN, SEQ ID NO:1281; | GDRLNVEVDTAPTVDLN, SEQ ID NO:1282; |
| DRLNVEVDAAPTVDLNQ, SEQ ID NO:1283; | DRLNVEVDAAPTVDLNR, SEQ ID NO:1284; |
| DRLNVEVDTAPTVDLNQ, SEQ ID NO:1285; | DRLNVEVDTAPTVDLNR, SEQ ID NO:1286; |
| RLNVEVDAAPTVDLNQV, SEQ ID NO:1287; | RLNVEVDAAPTVDLNRV, SEQ ID NO:1288; |
| RLNVEVDTAPTVDLNQV, SEQ ID NO:1289; | RLNVEVDTAPTVDLNRV, SEQ ID NO:1290; |
| LNVEVDAAPTVDLNQVL, SEQ ID NO:1291; | LNVEVDAAPTVDLNRVL, SEQ ID NO:1292; |
| LNVEVDTAPTVDLNQVL, SEQ ID NO:1293; | LNVEVDTAPTVDLNRVL, SEQ ID NO:1294; |
| NVEVDAAPTVDLNQVLN, SEQ ID NO:1295; | NVEVDAAPTVDLNRVLN, SEQ ID NO:1296; |
| NVEVDTAPTVDLNQVLN, SEQ ID NO:1297; | NVEVDTAPTVDLNRVLN, SEQ ID NO:1298; |
| VEVDAAPTVDLNQVLNE, SEQ ID NO:1299; | VEVDAAPTVDLNRVLNE, SEQ ID NO:1300; |
| VEVDTAPTVDLNQVLNE, SEQ ID NO:1301; | VEVDTAPTVDLNRVLNE, SEQ ID NO:1302; |
| EVDAAPTVDLNQVLNET, SEQ ID NO:1303; | EVDAAPTVDLNRVLNET, SEQ ID NO:1304; |
| EVDTAPTVDLNQVLNET, SEQ ID NO:1305; | EVDTAPTVDLNRVLNET, SEQ ID NO:1306; |
| VDAAPTVDLNQVLNETR, SEQ ID NO:1307; | VDAAPTVDLNRVLNETR, SEQ ID NO:1308; |
| VDTAPTVDLNQVLNETR, SEQ ID NO:1309; | VDTAPTVDLNRVLNETR, SEQ ID NO:1310; |
| DAAPTVDLNQVLNETRS, SEQ ID NO:1311; | DAAPTVDLNQVLNETRN, SEQ ID NO:1312; |
| DAAPTVDLNRVLNETRS, SEQ ID NO:1313; | DAAPTVDLNRVLNETRN, SEQ ID NO:1314; |
| DTAPTVDLNQVLNETRS, SEQ ID NO:1315; | DTAPTVDLNQVLNETRN, SEQ ID NO:1316; |
| DTAPTVDLNRVLNETRS, SEQ ID NO:1317; | DTAPTVDLNRVLNETRN, SEQ ID NO:1318; |
| AAPTVDLNQVLNETRSQ, SEQ ID NO:1319; | AAPTVDLNQVLNETRNQ, SEQ ID NO:1320; |
| AAPTVDLNRVLNETRSQ, SEQ ID NO:1321; | AAPTVDLNRVLNETRNQ, SEQ ID NO:1322; |
| TAPTVDLNQVLNETRSQ, SEQ ID NO:1323; | TAPTVDLNQVLNETRNQ, SEQ ID NO:1324; |
| TAPTVDLNRVLNETRSQ, SEQ ID NO:1325; | TAPTVDLNRVLNETRNQ, SEQ ID NO:1326; |
| APTVDLNQVLNETRSQY, SEQ ID NO:1327; | APTVDLNQVLNETRNQY, SEQ ID NO:1328; |
| APTVDLNRVLNETRSQY, SEQ ID NO:1329; | APTVDLNRVLNETRNQY, SEQ ID NO:1330; |
| PTVDLNQVLNETRSQYE, SEQ ID NO:1331; | PTVDLNQVLNETRNQYE, SEQ ID NO:1332; |
| PTVDLNRVLNETRSQYE, SEQ ID NO:1333; | PTVDLNRVLNETRNQYE, SEQ ID NO:1334; |
| TVDLNQVLNETRSQYEA, SEQ ID NO:1335; | TVDLNQVLNETRNQYEA, SEQ ID NO:1336; |
| TVDLNRVLNETRSQYEA, SEQ ID NO:1337; | TVDLNRVLNETRNQYEA, SEQ ID NO:1338; |
| VDLNQVLNETRSQYEAL, SEQ ID NO:1339; | VDLNQVLNETRNQYEAL, SEQ ID NO:1340; |
| VDLNRVLNETRSQYEAL, SEQ ID NO:1341; | VDLNRVLNETRNQYEAL, SEQ ID NO:1342; |
| EVNTLRCQLGDRLNVEVD, SEQ ID NO:1343; | EVNTLRCPLGDRLNVEVD, SEQ ID NO:1344; |
| EVNTLRSQLGDRLNVEVD, SEQ ID NO:1345; | EVNTLRSPLGDRLNVEVD, SEQ ID NO:1346; |
| VNTLRCQLGDRLNVEVDA, SEQ ID NO:1347; | VNTLRCQLGDRLNVEVDT, SEQ ID NO:1348; |
| VNTLRCPLGDRLNVEVDA, SEQ ID NO:1349; | VNTLRCPLGDRLNVEVDT, SEQ ID NO:1350; |
| VNTLRSQLGDRLNVEVDA, SEQ ID NO:1351; | VNTLRSQLGDRLNVEVDT, SEQ ID NO:1352; |
| VNTLRSPLGDRLNVEVDA, SEQ ID NO:1353; | VNTLRSPLGDRLNVEVDT, SEQ ID NO:1354; |
| NTLRCQLGDRLNVEVDAA, SEQ ID NO:1355; | NTLRCQLGDRLNVEVDTA, SEQ ID NO:1356; |
| NTLRCPLGDRLNVEVDAA, SEQ ID NO:1357; | NTLRCPLGDRLNVEVDTA, SEQ ID NO:1358; |
| NTLRSQLGDRLNVEVDAA, SEQ ID NO:1359; | NTLRSQLGDRLNVEVDTA, SEQ ID NO:1360; |
| NTLRSPLGDRLNVEVDAA, SEQ ID NO:1361; | NTLRSPLGDRLNVEVDTA, SEQ ID NO:1362; |

-continued

```
TLRCQLGDRLNVEVDAAP, SEQ ID NO:1363;      TLRCQLGDRLNVEVDTAP, SEQ ID NO:1364;
TLRCPLGDRLNVEVDAAP, SEQ ID NO:1365;      TLRCPLGDRLNVEVDTAP, SEQ ID NO:1366;
TLRSQLGDRLNVEVDAAP, SEQ ID NO:1367;      TLRSQLGDRLNVEVDTAP, SEQ ID NO:1368;
TLRSPLGDRLNVEVDAAP, SEQ ID NO:1369;      TLRSPLGDRLNVEVDTAP, SEQ ID NO:1370;
LRCQLGDRLNVEVDAAPT, SEQ ID NO:1371;      LRCQLGDRLNVEVDTAPT, SEQ ID NO:1372;
LRCPLGDRLNVEVDAAPT, SEQ ID NO:1373;      LRCPLGDRLNVEVDTAPT, SEQ ID NO:1374;
LRSQLGDRLNVEVDAAPT, SEQ ID NO:1375;      LRSQLGDRLNVEVDTAPT, SEQ ID NO:1376;
LRSPLGDRLNVEVDAAPT, SEQ ID NO:1377;      LRSPLGDRLNVEVDTAPT, SEQ ID NO:1378;
RCQLGDRLNVEVDAAPTV, SEQ ID NO:1379;      RCQLGDRLNVEVDTAPTV, SEQ ID NO:1380;
RCPLGDRLNVEVDAAPTV, SEQ ID NO:1381;      RCPLGDRLNVEVDTAPTV, SEQ ID NO:1382;
RSQLGDRLNVEVDAAPTV, SEQ ID NO:1383;      RSQLGDRLNVEVDTAPTV, SEQ ID NO:1384;
RSPLGDRLNVEVDAAPTV, SEQ ID NO:1385;      RSPLGDRLNVEVDTAPTV, SEQ ID NO:1386;
CQLGDRLNVEVDAAPTVD, SEQ ID NO:1387;      CQLGDRLNVEVDTAPTVD, SEQ ID NO:1388;
CPLGDRLNVEVDAAPTVD, SEQ ID NO:1389;      CPLGDRLNVEVDTAPTVD, SEQ ID NO:1390;
SQLGDRLNVEVDAAPTVD, SEQ ID NO:1391;      SQLGDRLNVEVDTAPTVD, SEQ ID NO:1392;
SPLGDRLNVEVDAAPTVD, SEQ ID NO:1393;      SPLGDRLNVEVDTAPTVD, SEQ ID NO:1394;
QLGDRLNVEVDAAPTVDL, SEQ ID NO:1395;      QLGDRLNVEVDTAPTVDL, SEQ ID NO:1396;
PLGDRLNVEVDAAPTVDL, SEQ ID NO:1397;      PLGDRLNVEVDTAPTVDL, SEQ ID NO:1398;
LGDRLNVEVDAAPTVDLN, SEQ ID NO:1399;      LGDRLNVEVDTAPTVDLN, SEQ ID NO:1400;
GDRLNVEVDAAPTVDLNQ, SEQ ID NO:1401;      GDRLNVEVDAAPTVDLNR, SEQ ID NO:1402;
GDRLNVEVDTAPTVDLNQ, SEQ ID NO:1403;      GDRLNVEVDTAPTVDLNR, SEQ ID NO:1404;
DRLNVEVDAAPTVDLNQV, SEQ ID NO:1405;      DRLNVEVDAAPTVDLNRV, SEQ ID NO:1406;
DRLNVEVDTAPTVDLNQV, SEQ ID NO:1407;      DRLNVEVDTAPTVDLNRV, SEQ ID NO:1408;
RLNVEVDAAPTVDLNQVL, SEQ ID NO:1409;      RLNVEVDAAPTVDLNRVL, SEQ ID NO:1410;
RLNVEVDTAPTVDLNQVL, SEQ ID NO:1411;      RLNVEVDTAPTVDLNRVL, SEQ ID NO:1412;
LNVEVDAAPTVDLNQVLN, SEQ ID NO:1413;      LNVEVDAAPTVDLNRVLN, SEQ ID NO:1414;
LNVEVDTAPTVDLNQVLN, SEQ ID NO:1415;      LNVEVDTAPTVDLNRVLN, SEQ ID NO:1416;
NVEVDAAPTVDLNQVLNE, SEQ ID NO:1417;      NVEVDAAPTVDLNRVLNE, SEQ ID NO:1418;
NVEVDTAPTVDLNQVLNE, SEQ ID NO:1419;      NVEVDTAPTVDLNRVLNE, SEQ ID NO:1420;
VEVDAAPTVDLNQVLNET, SEQ ID NO:1421;      VEVDAAPTVDLNRVLNET, SEQ ID NO:1422;
VEVDTAPTVDLNQVLNET, SEQ ID NO:1423;      VEVDTAPTVDLNRVLNET, SEQ ID NO:1424;
EVDAAPTVDLNQVLNETR, SEQ ID NO:1425;      EVDAAPTVDLNRVLNETR, SEQ ID NO:1426;
EVDTAPTVDLNQVLNETR, SEQ ID NO:1427;      EVDTAPTVDLNRVLNETR, SEQ ID NO:1428;
VDAAPTVDLNQVLNETRS, SEQ ID NO:1429;      VDAAPTVDLNQVLNETRN, SEQ ID NO:1430;
VDAAPTVDLNRVLNETRS, SEQ ID NO:1431;      VDAAPTVDLNRVLNETRN, SEQ ID NO:1432;
VDTAPTVDLNQVLNETRS, SEQ ID NO:1433;      VDTAPTVDLNQVLNETRN, SEQ ID NO:1434;
VDTAPTVDLNRVLNETRS, SEQ ID NO:1435;      VDTAPTVDLNRVLNETRN, SEQ ID NO:1436;
DAAPTVDLNQVLNETRSQ, SEQ ID NO:1437;      DAAPTVDLNQVLNETRNQ, SEQ ID NO:1438;
DAAPTVDLNRVLNETRSQ, SEQ ID NO:1439;      DAAPTVDLNRVLNETRNQ, SEQ ID NO:1440;
DTAPTVDLNQVLNETRSQ, SEQ ID NO:1441;      DTAPTVDLNQVLNETRNQ, SEQ ID NO:1442;
DTAPTVDLNRVLNETRSQ, SEQ ID NO:1443;      DTAPTVDLNRVLNETRNQ, SEQ ID NO:1444;
AAPTVDLNQVLNETRSQY, SEQ ID NO:1445;      AAPTVDLNQVLNETRNQY, SEQ ID NO:1446;
AAPTVDLNRVLNETRSQY, SEQ ID NO:1447;      AAPTVDLNRVLNETRNQY, SEQ ID NO:1448;
TAPTVDLNQVLNETRSQY, SEQ ID NO:1449;      TAPTVDLNQVLNETRNQY, SEQ ID NO:1450;
TAPTVDLNRVLNETRSQY, SEQ ID NO:1451;      TAPTVDLNRVLNETRNQY, SEQ ID NO:1452;
APTVDLNQVLNETRSQYE, SEQ ID NO:1453;      APTVDLNQVLNETRNQYE, SEQ ID NO:1454;
APTVDLNRVLNETRSQYE, SEQ ID NO:1455;      APTVDLNRVLNETRNQYE, SEQ ID NO:1456;
PTVDLNQVLNETRSQYEA, SEQ ID NO:1457;      PTVDLNQVLNETRSQYEA, SEQ ID NO:1458;
PTVDLNRVLNETRSQYEA, SEQ ID NO:1459;      PTVDLNRVLNETRNQYEA, SEQ ID NO:1460;
TVDLNQVLNETRSQYEAL, SEQ ID NO:1461;      TVDLNQVLNETRNQYEAL, SEQ ID NO:1462;
TVDLNRVLNETRSQYEAL, SEQ ID NO:1463;      TVDLNRVLNETRNQYEAL, SEQ ID NO:1464;
EVNTLRCQLGDRLNVEVDA, SEQ ID NO:1465;     EVNTLRCQLGDRLNVEVDT, SEQ ID NO:1466;
EVNTLRCPLGDRLNVEVDA, SEQ ID NO:1467;     EVNTLRCPLGDRLNVEVDT, SEQ ID NO:1468;
EVNTLRSQLGDRLNVEVDA, SEQ ID NO:1469;     EVNTLRSQLGDRLNVEVDT, SEQ ID NO:1470;
EVNTLRSPLGDRLNVEVDA, SEQ ID NO:1471;     EVNTLRSPLGDRLNVEVDT, SEQ ID NO:1472;
VNTLRCQLGDRLNVEVDAA, SEQ ID NO:1473;     VNTLRCQLGDRLNVEVDTA, SEQ ID NO:1474;
VNTLRCPLGDRLNVEVDAA, SEQ ID NO:1475;     VNTLRCPLGDRLNVEVDTA, SEQ ID NO:1476;
VNTLRSQLGDRLNVEVDAA, SEQ ID NO:1477;     VNTLRSQLGDRLNVEVDTA, SEQ ID NO:1478;
VNTLRSPLGDRLNVEVDAA, SEQ ID NO:1479;     VNTLRSPLGDRLNVEVDTA, SEQ ID NO:1480;
VNTLRCQLGDRLNVEVDAA, SEQ ID NO:1481;     VNTLRCQLGDRLNVEVDTA, SEQ ID NO:1482;
VNTLRCPLGDRLNVEVDAA, SEQ ID NO:1483;     VNTLRCPLGDRLNVEVDTA, SEQ ID NO:1484;
VNTLRSQLGDRLNVEVDAA, SEQ ID NO:1485;     VNTLRSQLGDRLNVEVDTA, SEQ ID NO:1486;
VNTLRSPLGDRLNVEVDAA, SEQ ID NO:1487;     VNTLRSPLGDRLNVEVDTA, SEQ ID NO:1488;
TLRCQLGDRLNVEVDAAPT, SEQ ID NO:1489;     TLRCQLGDRLNVEVDTAPT, SEQ ID NO:1490;
TLRCPLGDRLNVEVDAAPT, SEQ ID NO:1491;     TLRCPLGDRLNVEVDTAPT, SEQ ID NO:1492;
TLRSQLGDRLNVEVDAAPT, SEQ ID NO:1493;     TLRSQLGDRLNVEVDTAPT, SEQ ID NO:1494;
TLRSPLGDRLNVEVDAAPT, SEQ ID NO:1495;     TLRSPLGDRLNVEVDTAPT, SEQ ID NO:1496;
LRCQLGDRLNVEVDAAPTV, SEQ ID NO:1497;     LRCQLGDRLNVEVDTAPTV, SEQ ID NO:1498;
LRCPLGDRLNVEVDAAPTV, SEQ ID NO:1499;     LRCPLGDRLNVEVDTAPTV, SEQ ID NO:1500;
LRSQLGDRLNVEVDAAPTV, SEQ ID NO:1501;     LRSQLGDRLNVEVDTAPTV, SEQ ID NO:1502;
LRSPLGDRLNVEVDAAPTV, SEQ ID NO:1503;     LRSPLGDRLNVEVDTAPTV, SEQ ID NO:1504;
LRCQLGDRLNVEVDAAPTV, SEQ ID NO:1505;     LRCQLGDRLNVEVDTAPTV, SEQ ID NO:1506;
LRCPLGDRLNVEVDAAPTV, SEQ ID NO:1507;     LRCPLGDRLNVEVDTAPTV, SEQ ID NO:1508;
LRSQLGDRLNVEVDAAPTV, SEQ ID NO:1509;     LRSQLGDRLNVEVDTAPTV, SEQ ID NO:1510;
LRSPLGDRLNVEVDAAPTV, SEQ ID NO:1511;     LRSPLGDRLNVEVDTAPTV, SEQ ID NO:1512;
LRCQLGDRLNVEVDAAPTV, SEQ ID NO:1513;     LRCQLGDRLNVEVDTAPTV, SEQ ID NO:1514;
LRCPLGDRLNVEVDAAPTV, SEQ ID NO:1515;     LRCPLGDRLNVEVDTAPTV, SEQ ID NO:1516;
LRSQLGDRLNVEVDAAPTV, SEQ ID NO:1517;     LRSQLGDRLNVEVDTAPTV, SEQ ID NO:1518;
LRSPLGDRLNVEVDAAPTV, SEQ ID NO:1519;     LRSPLGDRLNVEVDTAPTV, SEQ ID NO:1520;
QLGDRLNVEVDAAPTVDLN, SEQ ID NO:1521;     QLGDRLNVEVDTAPTVDLN, SEQ ID NO:1522;
```

-continued

| | |
|---|---|
| PLGDRLNVEVDAAPTVDLN, SEQ ID NO:1523; | PLGDRLNVEVDTAPTVDLN, SEQ ID NO:1524; |
| LGDRLNVEVDAAPTVDLNQ, SEQ ID NO:1525; | LGDRLNVEVDAAPTVDLNR, SEQ ID NO:1526; |
| LGDRLNVEVDTAPTVDLNQ, SEQ ID NO:1527; | LGDRLNVEVDTAPTVDLNR, SEQ ID NO:1528; |
| GDRLNVEVDAAPTVDLNQV, SEQ ID NO:1529; | GDRLNVEVDAAPTVDLNRV, SEQ ID NO:1530; |
| GDRLNVEVDTAPTVDLNQV, SEQ ID NO:1531; | GDRLNVEVDTAPTVDLNRV, SEQ ID NO:1532; |
| DRLNVEVDAAPTVDLNQVL, SEQ ID NO:1533; | DRLNVEVDAAPTVDLNRVL, SEQ ID NO:1534; |
| DRLNVEVDTAPTVDLNQVL, SEQ ID NO:1535; | DRLNVEVDTAPTVDLNRVL, SEQ ID NO:1536; |
| RLNVEVDAAPTVDLNQVLN, SEQ ID NO:1537; | RLNVEVDAAPTVDLNRVLN, SEQ ID NO:1538; |
| RLNVEVDTAPTVDLNQVLN, SEQ ID NO:1539; | RLNVEVDTAPTVDLNRVLN, SEQ ID NO:1540; |
| LNVEVDAAPTVDLNQVLNE, SEQ ID NO:1541; | LNVEVDAAPTVDLNRVLNE, SEQ ID NO:1542; |
| LNVEVDTAPTVDLNQVLNE, SEQ ID NO:1543; | LNVEVDTAPTVDLNRVLNE, SEQ ID NO:1544; |
| NVEVDAAPTVDLNQVLNET, SEQ ID NO:1545; | NVEVDAAPTVDLNRVLNET, SEQ ID NO:1546; |
| NVEVDTAPTVDLNQVLNET, SEQ ID NO:1547; | NVEVDTAPTVDLNRVLNET, SEQ ID NO:1548; |
| VEVDAAPTVDLNQVLNETR, SEQ ID NO:1549; | VEVDAAPTVDLNRVLNETR, SEQ ID NO:1550; |
| VEVDTAPTVDLNQVLNETR, SEQ ID NO:1551; | VEVDTAPTVDLNRVLNETR, SEQ ID NO:1552; |
| EVDAAPTVDLNQVLNETRS, SEQ ID NO:1553; | EVDAAPTVDLNQVLNETRN, SEQ ID NO:1554; |
| EVDAAPTVDLNRVLNETRS, SEQ ID NO:1555; | EVDAAPTVDLNRVLNETRN, SEQ ID NO:1556; |
| EVDTAPTVDLNQVLNETRS, SEQ ID NO:1557; | EVDTAPTVDLNQVLNETRN, SEQ ID NO:1558; |
| EVDTAPTVDLNRVLNETRS, SEQ ID NO:1559; | EVDTAPTVDLNRVLNETRN, SEQ ID NO:1560; |
| VDAAPTVDLNQVLNETRSQ, SEQ ID NO:1561; | VDAAPTVDLNQVLNETRNQ, SEQ ID NO:1562; |
| VDAAPTVDLNRVLNETRSQ, SEQ ID NO:1563; | VDAAPTVDLNRVLNETRNQ, SEQ ID NO:1564; |
| VDTAPTVDLNQVLNETRSQ, SEQ ID NO:1565; | VDTAPTVDLNQVLNETRNQ, SEQ ID NO:1566; |
| VDTAPTVDLNRVLNETRSQ, SEQ ID NO:1567; | VDTAPTVDLNRVLNETRNQ, SEQ ID NO:1568; |
| DAAPTVDLNQVLNETRSQY, SEQ ID NO:1569; | DAAPTVDLNQVLNETRNQY, SEQ ID NO:1570; |
| DAAPTVDLNRVLNETRSQY, SEQ ID NO:1571; | DAAPTVDLNRVLNETRNQY, SEQ ID NO:1572; |
| DTAPTVDLNQVLNETRSQY, SEQ ID NO:1573; | DTAPTVDLNQVLNETRNQY, SEQ ID NO:1574; |
| DTAPTVDLNRVLNETRSQY, SEQ ID NO:1575; | DTAPTVDLNRVLNETRNQY, SEQ ID NO:1576; |
| AAPTVDLNQVLNETRSQYE, SEQ ID NO:1577; | AAPTVDLNQVLNETRNQYE, SEQ ID NO:1578; |
| AAPTVDLNRVLNETRSQYE, SEQ ID NO:1579; | AAPTVDLNRVLNETRNQYE, SEQ ID NO:1580; |
| TAPTVDLNQVLNETRSQYE, SEQ ID NO:1581; | TAPTVDLNQVLNETRNQYE, SEQ ID NO:1582; |
| TAPTVDLNRVLNETRSQYE, SEQ ID NO:1583; | TAPTVDLNRVLNETRNQYE, SEQ ID NO:1584; |
| APTVDLNQVLNETRSQYEA, SEQ ID NO:1585; | APTVDLNQVLNETRNQYEA, SEQ ID NO:1586; |
| APTVDLNRVLNETRSQYEA, SEQ ID NO:1587; | APTVDLNRVLNETRNQYEA, SEQ ID NO:1588; |
| PTVDLNQVLNETRSQYEAL, SEQ ID NO:1589; | PTVDLNQVLNETRNQYEAL, SEQ ID NO:1590; |
| PTVDLNRVLNETRSQYEAL, SEQ ID NO:1591; | PTVDLNRVLNETRNQYEAL, SEQ ID NO:1592; |
| EVNTLRCQLGDRLNVEVDAA, SEQ ID NO:1593; | EVNTLRCQLGDRLNVEVDTA, SEQ ID NO:1594; |
| EVNTLRCPLGDRLNVEVDAA, SEQ ID NO:1595; | EVNTLRCPLGDRLNVEVDTA, SEQ ID NO:1596; |
| EVNTLRSQLGDRLNVEVDAA, SEQ ID NO:1597; | EVNTLRSQLGDRLNVEVDTA, SEQ ID NO:1598; |
| EVNTLRSPLGDRLNVEVDAA, SEQ ID NO:1599; | EVNTLRSPLGDRLNVEVDTA, SEQ ID NO:1600; |
| VNTLRCQLGDRLNVEVDAAP, SEQ ID NO:1601; | VNTLRCQLGDRLNVEVDTAP, SEQ ID NO:1602; |
| VNTLRCPLGDRLNVEVDAAP, SEQ ID NO:1603; | VNTLRCPLGDRLNVEVDTAP, SEQ ID NO:1604; |
| VNTLRSQLGDRLNVEVDAAP, SEQ ID NO:1605; | VNTLRSQLGDRLNVEVDTAP, SEQ ID NO:1606; |
| VNTLRSPLGDRLNVEVDAAP, SEQ ID NO:1607; | VNTLRSPLGDRLNVEVDTAP, SEQ ID NO:1608; |
| NTLRCQLGDRLNVEVDAAPT, SEQ ID NO:1609; | NTLRCQLGDRLNVEVDTAPT, SEQ ID NO:1610; |
| NTLRCPLGDRLNVEVDAAPT, SEQ ID NO:1611; | NTLRCPLGDRLNVEVDTAPT, SEQ ID NO:1612; |
| NTLRSQLGDRLNVEVDAAPT, SEQ ID NO:1613; | NTLRSQLGDRLNVEVDTAPT, SEQ ID NO:1614; |
| NTLRSPLGDRLNVEVDAAPT, SEQ ID NO:1615; | NTLRSPLGDRLNVEVDTAPT, SEQ ID NO:1616; |
| TLRCQLGDRLNVEVDAAPTV, SEQ ID NO:1617; | TLRCQLGDRLNVEVDTAPTV, SEQ ID NO:1618; |
| TLRCPLGDRLNVEVDAAPTV, SEQ ID NO:1619; | TLRCPLGDRLNVEVDTAPTV, SEQ ID NO:1620; |
| TLRSQLGDRLNVEVDAAPTV, SEQ ID NO:1621; | TLRSQLGDRLNVEVDTAPTV, SEQ ID NO:1622; |
| TLRSPLGDRLNVEVDAAPTV, SEQ ID NO:1623; | TLRSPLGDRLNVEVDTAPTV, SEQ ID NO:1624; |
| LRCQLGDRLNVEVDAAPTVD, SEQ ID NO:1625; | LRCQLGDRLNVEVDTAPTVD, SEQ ID NO:1626; |
| LRCPLGDRLNVEVDAAPTVD, SEQ ID NO:1627; | LRCPLGDRLNVEVDTAPTVD, SEQ ID NO:1628; |
| LRSQLGDRLNVEVDAAPTVD, SEQ ID NO:1629; | LRSQLGDRLNVEVDTAPTVD, SEQ ID NO:1630; |
| LRSPLGDRLNVEVDAAPTVD, SEQ ID NO:1631; | LRSPLGDRLNVEVDTAPTVD, SEQ ID NO:1632; |
| RCQLGDRLNVEVDAAPTVDL, SEQ ID NO:1633; | RCQLGDRLNVEVDTAPTVDL, SEQ ID NO:1634; |
| RCPLGDRLNVEVDAAPTVDL, SEQ ID NO:1635; | RCPLGDRLNVEVDTAPTVDL, SEQ ID NO:1636; |
| RSQLGDRLNVEVDAAPTVDL, SEQ ID NO:1637; | RSQLGDRLNVEVDTAPTVDL, SEQ ID NO:1638; |
| RSPLGDRLNVEVDAAPTVDL, SEQ ID NO:1639; | RSPLGDRLNVEVDTAPTVDL, SEQ ID NO:1640; |
| CQLGDRLNVEVDAAPTVDLN, SEQ ID NO:1641; | CQLGDRLNVEVDTAPTVDLN, SEQ ID NO:1642; |
| CPLGDRLNVEVDAAPTVDLN, SEQ ID NO:1643; | CPLGDRLNVEVDTAPTVDLN, SEQ ID NO:1644; |
| SQLGDRLNVEVDAAPTVDLN, SEQ ID NO:1645; | SQLGDRLNVEVDTAPTVDLN, SEQ ID NO:1646; |
| SPLGDRLNVEVDAAPTVDLN, SEQ ID NO:1647; | SPLGDRLNVEVDTAPTVDLN, SEQ ID NO:1648; |
| QLGDRLNVEVDAAPTVDLNQ, SEQ ID NO:1649; | QLGDRLNVEVDAAPTVDLNR, SEQ ID NO:1650; |
| QLGDRLNVEVDTAPTVDLNQ, SEQ ID NO:1651; | QLGDRLNVEVDTAPTVDLNR, SEQ ID NO:1652; |
| PLGDRLNVEVDAAPTVDLNQ, SEQ ID NO:1653; | PLGDRLNVEVDAAPTVDLNR, SEQ ID NO:1654; |
| PLGDRLNVEVDTAPTVDLNQ, SEQ ID NO:1655; | PLGDRLNVEVDTAPTVDLNR, SEQ ID NO:1656; |
| LGDRLNVEVDAAPTVDLNQV, SEQ ID NO:1657; | LGDRLNVEVDAAPTVDLNRV, SEQ ID NO:1658; |
| LGDRLNVEVDTAPTVDLNQV, SEQ ID NO:1659; | LGDRLNVEVDTAPTVDLNRV, SEQ ID NO:1660; |
| GDRLNVEVDAAPTVDLNQVL, SEQ ID NO:1661; | GDRLNVEVDAAPTVDLNRVL, SEQ ID NO:1662; |
| GDRLNVEVDTAPTVDLNQVL, SEQ ID NO:1663; | GDRLNVEVDTAPTVDLNRVL, SEQ ID NO:1664; |
| DRLNVEVDAAPTVDLNQVLN, SEQ ID NO:1665; | DRLNVEVDAAPTVDLNRVLN, SEQ ID NO:1666; |
| DRLNVEVDTAPTVDLNQVLN, SEQ ID NO:1667; | DRLNVEVDTAPTVDLNRVLN, SEQ ID NO:1668; |
| RLNVEVDAAPTVDLNQVLNE, SEQ ID NO:1669; | RLNVEVDAAPTVDLNRVLNE, SEQ ID NO:1670; |
| RLNVEVDTAPTVDLNQVLNE, SEQ ID NO:1671; | RLNVEVDTAPTVDLNRVLNE, SEQ ID NO:1672; |
| LNVEVDAAPTVDLNQVLNET, SEQ ID NO:1673; | LNVEVDAAPTVDLNRVLNET, SEQ ID NO:1674; |
| LNVEVDTAPTVDLNQVLNET, SEQ ID NO:1675; | LNVEVDTAPTVDLNRVLNET, SEQ ID NO:1676; |
| NVEVDAAPTVDLNQVLNETR, SEQ ID NO:1677; | NVEVDAAPTVDLNRVLNETR, SEQ ID NO:1678; |
| NVEVDTAPTVDLNQVLNETR, SEQ ID NO:1679; | NVEVDTAPTVDLNRVLNETR, SEQ ID NO:1680; |
| VEVDAAPTVDLNQVLNETRS, SEQ ID NO:1681; | VEVDAAPTVDLNQVLNETRN, SEQ ID NO:1682; |

-continued

| | |
|---|---|
| VEVDAAPTVDLNRVLNETRS, SEQ ID NO:1683; | VEVDAAPTVDLNRVLNETRN, SEQ ID NO:1684; |
| VEVDTAPTVDLNQVLNETRS, SEQ ID NO:1685; | VEVDTAPTVDLNQVLNETRN, SEQ ID NO:1686; |
| VEVDTAPTVDLNRVLNETRS, SEQ ID NO:1687; | VEVDTAPTVDLNRVLNETRN, SEQ ID NO:1688; |
| EVDAAPTVDLNQVLNETRSQ, SEQ ID NO:1689; | EVDAAPTVDLNQVLNETRNQ, SEQ ID NO:1690; |
| EVDAAPTVDLNRVLNETRSQ, SEQ ID NO:1691; | EVDAAPTVDLNRVLNETRNQ, SEQ ID NO:1692; |
| EVDTAPTVDLNQVLNETRSQ, SEQ ID NO:1693; | EVDTAPTVDLNQVLNETRNQ, SEQ ID NO:1694; |
| EVDTAPTVDLNRVLNETRSQ, SEQ ID NO:1695; | EVDTAPTVDLNRVLNETRNQ, SEQ ID NO:1696; |
| VDAAPTVDLNQVLNETRSQY, SEQ ID NO:1697; | VDAAIPTVDLNQVLNETRNQY, SEQ ID NO:1698; |
| VDAAPTVDLNRVLNETRSQY, SEQ ID NO:1699; | VDAAPTVDLNRVLNETRNQY, SEQ ID NO:1700; |
| VDTAPTVDLNQVLNETRSQY, SEQ ID NO:1701; | VDTAPTVDLNQVLNETRNQY, SEQ ID NO:1702; |
| VDTAPTVDLNRVLNETRSQY, SEQ ID NO:1703; | VDTAPTVDLNRVLNETRSQY, SEQ ID NO:1704; |
| DAAPTVDLNQVLNETRSQYE, SEQ ID NO:1705; | DAAPTVDLNQVLNETRNQYE, SEQ ID NO:1706; |
| DAAPTVDLNRVLNETRSQYE, SEQ ID NO:1707; | DAAPTVDLNRVLNETRNQYE, SEQ ID NO:1708; |
| DTAPTVDLNQVLNETRSQYE, SEQ ID NO:1709; | DTAPTVDLNQVLNETRNQYE, SEQ ID NO:1710; |
| DTAPTVDLNRVLNETRSQYE, SEQ ID NO:1711; | DTAPTVDLNRVLNETRNQYE, SEQ ID NO:1712; |
| AAPTVDLNQVLNETRSQYEA, SEQ ID NO:1713; | AAPTVDLNQVLNETRNQYEA, SEQ ID NO:1714; |
| AAPTVDLNRVLNETRSQYEA, SEQ ID NO:1715; | AAPTVDLNRVLNETRNQYEA, SEQ ID NO:1716; |
| TAPTVDLNQVLNETRSQYEA, SEQ ID NO:1717; | TAPTVDLNQVLNETRNQYEA, SEQ ID NO:1718; |
| TAPTVDLNRVLNETRSQYEA, SEQ ID NO:1719; | TAPTVDLNRVLNETRNQYEA, SEQ ID NO:1720; |
| APTVDLNQVLNETRSQYEAL, SEQ ID NO:1721; | APTVDLNQVLNETRNQYEAL, SEQ ID NO:1722; |
| APTVDLNRVLNETRSQYEAL, SEQ ID NO:1723; | APTVDLNRVLNETRNQYEAL, SEQ ID NO:1724; |

EVNTLRCQLGDRLNVEVDAAP, SEQ ID NO:1725;
EVNTLRCQLGDRLNVEVDTAP, SEQ ID NO:1726;
EVNTLRCPLGDRLNVEVDAAP, SEQ ID NO:1727;
EVNTLRCPLGDRLNVEVDTAP, SEQ ID NO:1728;
EVNTLRSQLGDRLNVEVDAAP, SEQ ID NO:1729;
EVNTLRSQLGDRLNVEVDTAP, SEQ ID NO:1730;
EVNTLRSPLGDRLNVEVDAAP, SEQ ID NO:1731;
EVNTLRSPLGDRLNVEVDTAP, SEQ ID NO:1732;
VNTLRCQLGDRLNVEVDAAPT, SEQ ID NO:1733;
VNTLRCQLGDRLNVEVDTAPT, SEQ ID NO:1734;
VNTLRCPLGDRLNVEVDAAPT, SEQ ID NO:1735;
VNTLRCPLGDRLNVEVDTAPT, SEQ ID NO:1736;
VNTLRSQLGDRLNVEVDAAPT, SEQ ID NO:1737;
VNTLRSQLGDRLNVEVDTAPT, SEQ ID NO:1738;
VNTLRSPLGDRLNVEVDAAPT, SEQ ID NO:1739;
VNTLRSPLGDRLNVEVDTAPT, SEQ ID NO:1740;
NTLRCQLGDRLNVEVDAAPTV, SEQ ID NO:1741;
NTLRCQLGDRLNVEVDTAPTV, SEQ ID NO:1742;
NTLRCPLGDRLNVEVDAAPTV, SEQ ID NO:1743;
NTLRCPLGDRLNVEVDTAPTV, SEQ ID NO:1744;
NTLRSQLGDRLNVEVDAAPTV, SEQ ID NO:1745;
NTLRSQLGDRLNVEVDTAPTV, SEQ ID NO:1746;
NTLRSPLGDRLNVEVDAAPTV, SEQ ID NO:1747;
NTLRSPLGDRLNVEVDTAPTV, SEQ ID NO:1748;
TLRCQLGDRLNVEVDAAPTVD, SEQ ID NO:1749;
TLRCQLGDRLNVEVDTAPTVD, SEQ ID NO:1750;
TLRCPLGDRLNVEVDAAPTVD, SEQ ID NO:1751;
TLRCPLGDRLNVEVDTAPTVD, SEQ ID NO:1752;
TLRSQLGDRLNVEVDAAPTVD, SEQ ID NO:1753;
TLRSQLGDRLNVEVDTAPTVD, SEQ ID NO:1754;
TLRSPLGDRLNVEVDAAPTVD, SEQ ID NO:1755;
TLRSPLGDRLNVEVDTAPTVD, SEQ ID NO:1756;
LRCQLGDRLNVEVDAAPTVDL, SEQ ID NO:1757;
LRCQLGDRLNVEVDTAPTVDL, SEQ ID NO:1758;
LRCPLGDRLNVEVDAAPTVDL, SEQ ID NO:1759;
LRCPLGDRLNVEVDTAPTVDL, SEQ ID NO:1760;
LRSQLGDRLNVEVDAAPTVDL, SEQ ID NO:1761;
LRSQLGDRLNVEVDTAPTVDL, SEQ ID NO:1762;
LRCPLGDRLNVEVDAAPTVDL, SEQ ID NO:1763;
LRSPLGDRLNVEVDTAPTVDL, SEQ ID NO:1764;
RCQLGDRLNVEVDAAPTVDLN, SEQ ID NO:1765;
RCQLGDRLNVEVDTAPTVDLN, SEQ ID NO:1766;
RCPLGDRLNVEVDAAPTVDLN, SEQ ID NO:1767;
RCPLGDRLNVEVDTAPTVDLN, SEQ ID NO:1768;
RSQLGDRLNVEVDAAPTVDLN, SEQ ID NO:1769;
RSQLGDRLNVEVDTAPTVDLN, SEQ ID NO:1770;
RSPLGDRLNVEVDAAPTVDLN, SEQ ID NO:1771;
RSPLGDRLNVEVDTAPTVDLN, SEQ ID NO:1772;
CQLGDRLNVEVDAAPTVDLNQ, SEQ ID NO:1773;
SQLGDRLNVEVDAAPTVDLNQ, SEQ ID NO:1774;
CPLGDRLNVEVDAAPTVDLNQ, SEQ ID NO:1775;
SPLGDRLNVEVDAAPTVDLNQ, SEQ ID NO:1776;
CQLGDRLNVEVDTAPTVDLNQ, SEQ ID NO:1777;
SQLGDRLNVEVDTAPTVDLNQ, SEQ ID NO:1778;
CPLGDRLNVEVDTAPTVDLNQ, SEQ ID NO:1779;
SPLGDRLNVEVDTAPTVDLNQ, SEQ ID NO:1780;
CQLGDRLNVEVDAAPTVDLNR, SEQ ID NO:1781;
SQLGDRLNVEVDAAPTVDLNR, SEQ ID NO:1782;
CPLGDRLNVEVDAAPTVDLNR, SEQ ID NO:1783;

```
                       -continued
SPLGDRLNVEVDAAPTVDLNR,  SEQ ID NO:1784;
CQLGDRLNVEVDTAPTVDLNR,  SEQ ID NO:1785;
SQLGDRLNVEVDTAPTVDLNR,  SEQ ID NO:1786;
CPLGDRLNVEVDTAPTVDLNR,  SEQ ID NO:1787;
SPLGDRLNVEVDTAPTVDLNR,  SEQ ID NO:1788;
QLGDRLNVEVDAAPTVDLNQV,  SEQ ID NO:1789;
QLGDRLNVEVDAAPTVDLNRV,  SEQ ID NO:1790;
QLGDRLNVEVDTAPTVDLNQV,  SEQ ID NO:1791;
QLGDRLNVEVDTAPTVDLNRV,  SEQ ID NO:1792;
PLGDRLNVEVDAAPTVDLNQV,  SEQ ID NO:1793;
PLGDRLNVEVDAAPTVDLNRV,  SEQ ID NO:1794;
PLGDRLNVEVDTAPTVDLNQV,  SEQ ID NO:1795;
PLGDRLNVEVDTAPTVDLNRV,  SEQ ID NO:1796;
LGDRLNVEVDAAPTVDLNQVL,  SEQ ID NO:1797;
LGDRLNVEVDAAPTVDLNRVL,  SEQ ID NO:1798;
LGDRLNVEVDTAPTVDLNQVL,  SEQ ID NO:1799;
LGDRLNVEVDTAPTVDLNRVL,  SEQ ID NO:1800;
GDRLNVEVDAAPTVDLNQVLN,  SEQ ID NO:1801;
GDRLNVEVDAAPTVDLNRVLN,  SEQ ID NO:1802;
GDRLNVEVDTAPTVDLNQVLN,  SEQ ID NO:1803;
GDRLNVEVDTAPTVDLNRVLN,  SEQ ID NO:1804;
DRLNVEVDAAPTVDLNQVLNE,  SEQ ID NO:1805;
DRLNVEVDAAPTVDLNRVLNE,  SEQ ID NO:1806;
DRLNVEVDTAPTVDLNQVLNE,  SEQ ID NO:1807;
DRLNVEVDTAPTVDLNRVLNE,  SEQ ID NO:1808;
RLNVEVDAAPTVDLNQVLNET,  SEQ ID NO:1809;
RLNVEVDAAPTVDLNRVLNET,  SEQ ID NO:1810;
RLNVEVDTAPTVDLNQVLNET,  SEQ ID NO:1811;
RLNVEVDTAPTVDLNRVLNET,  SEQ ID NO:1812;
LNVEVDAAPTVDLNQVLNETR,  SEQ ID NO:1813;
LNVEVDAAPTVDLNRVLNETR,  SEQ ID NO:1814;
LNVEVDTAPTVDLNQVLNETR,  SEQ ID NO:1815;
LNVEVDTAPTVDLNRVLNETR,  SEQ ID NO:1816;
NVEVDAAPTVDLNQVLNETRS,  SEQ ID NO:1817;
NVEVDAAPTVDLNQVLNETRN,  SEQ ID NO:1818;
NVEVDAAPTVDLNRVLNETRS,  SEQ ID NO:1819;
NVEVDAAPTVDLNRVLNETRN,  SEQ ID NO:1820;
NVEVDTAPTVDLNQVLNETRS,  SEQ ID NO:1821;
NVEVDTAPTVDLNQVLNETRN,  SEQ ID NO:1822;
NVEVDTAPTVDLNRVLNETRS,  SEQ ID NO:1823;
NVEVDTAPTVDLNRVLNETRN,  SEQ ID NO:1824;
VEVDAAPTVDLNQVLNETRSQ,  SEQ ID NO:1825;
VEVDAAPTVDLNQVLNETRNQ,  SEQ ID NO:1826;
VEVDAAPTVDLNRVLNETRSQ,  SEQ ID NO:1827;
VEVDAAPTVDLNRVLNETRNQ,  SEQ ID NO:1828;
VEVDTAPTVDLNQVLNETRSQ,  SEQ ID NO:1829;
VEVDTAPTVDLNQVLNETRNQ,  SEQ ID NO:1830;
VEVDTAPTVDLNRVLNETRSQ,  SEQ ID NO:1831;
VEVDTAPTVDLNRVLNETRNQ,  SEQ ID NO:1832;
EVDAAPTVDLNQVLNETRSQY,  SEQ ID NO:1833;
EVDAAPTVDLNQVLNETRNQY,  SEQ ID NO:1834;
EVDAAPTVDLNRVLNETRSQY,  SEQ ID NO:1835;
EVDAAPTVDLNRVLNETRNQY,  SEQ ID NO:1836;
EVDTAPTVDLNQVLNETRSQY,  SEQ ID NO:1837;
EVDTAPTVDLNQVLNETRNQY,  SEQ ID NO:1838;
EVDTAPTVDLNRVLNETRSQY,  SEQ ID NO:1839;
EVDTAPTVDLNRVLNETRNQY,  SEQ ID NO:1840;
VDAAPTVDLNQVLNETRSQYE,  SEQ ID NO:1841;
VDAAPTVDLNQVLNETRNQYE,  SEQ ID NO:1842;
VDAAPTVDLNRVLNETRSQYE,  SEQ ID NO:1843;
VDAAPTVDLNRVLNETRNQYE,  SEQ ID NO:1844;
VDTAPTVDLNQVLNETRSQYE,  SEQ ID NO:1845;
VDTAPTVDLNQVLNETRNQYE,  SEQ ID NO:1846;
VDTAPTVDLNRVLNETRSQYE,  SEQ ID NO:1847;
VDTAPTVDLNRVLNETRNQYE,  SEQ ID NO:1848;
DAAPTVDLNQVLNETRSQYEA,  SEQ ID NO:1849;
DAAPTVDLNQVLNETRNQYEA,  SEQ ID NO:1850;
DAAPTVDLNRVLNETRSQYEA,  SEQ ID NO:1851;
DAAPTVDLNRVLNETRNQYEA,  SEQ ID NO:1852;
DTAPTVDLNQVLNETRSQYEA,  SEQ ID NO:1853;
DTAPTVDLNQVLNETRNQYEA,  SEQ ID NO:1854;
DTAPTVDLNRVLNETRSQYEA,  SEQ ID NO:1855;
DTAPTVDLNRVLNETRNQYEA,  SEQ ID NO:1856;
AAPTVDLNQVLNETRSQYEAL,  SEQ ID NO:1857;
AAPTVDLNQVLNETRNQYEAL,  SEQ ID NO:1858;
AAPTVDLNRVLNETRSQYEAL,  SEQ ID NO:1859;
AAPTVDLNRVLNETRNQYEAL,  SEQ ID NO:1860;
TAPTVDLNQVLNETRSQYEAL,  SEQ ID NO:1861;
TAPTVDLNQVLNETRNQYEAL,  SEQ ID NO:1862;
TAPTVDLNRVLNETRSQYEAL,  SEQ ID NO:1863;
```

-continued

```
TAPTVDLNRVLNETRNQYEAL,    SEQ ID NO:1864;
EVNTLRCQLGDRLNVEVDAAPT,   SEQ ID NO;1865:
EVNTLRCQLGDRLNVEVDTAPT,   SEQ ID NO;1866:
EVNTLRCPLGDRLNVEVDAAPT,   SEQ ID NO;1867:
EVNTLRCPLGDRLNVEVDTAPT,   SEQ ID NO;1868:
EVNTLRSQLGDRLNVEVDAAPT,   SEQ ID NO;1869:
EVNTLRSQLGDRLNVEVDTAPT,   SEQ ID NO:1870;
EVNTLRSPLGDRLNVEVDAAPT,   SEQ ID NO;1871:
EVNTLRSPLGDRLNVEVDTAPT,   SEQ ID NO:1872;
VNTLRCQLGDRLNVEVDAAPTV,   SEQ ID NO:1873;
VNTLRCQLGDRLNVEVDTAPTV,   SEQ ID NO:1874;
VNTLRCPLGDRLNVEVDAAPTV,   SEQ ID NO:1875;
VNTLRCPLGDRLNVEVDTAPTV,   SEQ ID NO:1876;
VNTLRSQLGDRLNVEVDAAPTV,   SEQ ID NO:1877;
VNTLRSQLGDRLNVEVDTAPTV,   SEQ ID NO:1878;
VNTLRSPLGDRLNVEVDAAPTV,   SEQ ID NO:1879;
VNTLRSPLGDRLNVEVDTAPTV,   SEQ ID NO:1880;
NTLRCQLGDRLNVEVDAAPTVD,   SEQ ID NO:1881;
NTLRCQLGDRLNVEVDTAPTVD,   SEQ ID NO:1882;
NTLRCPLGDRLNVEVDAAPTVD,   SEQ ID NO:1883;
NTLRCPLGDRLNVEVDTAPTVD,   SEQ ID NO:1884;
NTLRSQLGDRLNVEVDAAPTVD,   SEQ ID NO:1885;
NTLRSQLGDRLNVEVDTAPTVD,   SEQ ID NO:1886;
NTLRSPLGDRLNVEVDAAPTVD,   SEQ ID NO:1887;
NTLRSPLGDRLNVEVDTAPTVD,   SEQ ID NO:1888;
TLRCQLGDRLNVEVDAAPTVDL,   SEQ ID NO:1889;
TLRCQLGDRLNVEVDTAPTVDL,   SEQ ID NO:1890;
TLRCPLGDRLNVEVDAAPTVDL,   SEQ ID NO:1891;
TLRCPLGDRLNVEVDTAPTVDL,   SEQ ID NO:1892;
TLRSQLGDRLNVEVDAAPTVDL,   SEQ ID NO:1893;
TLRSQLGDRLNVEVDTAPTVDL,   SEQ ID NO:1894;
TLRSPLGDRLNVEVDAAPTVDL,   SEQ ID NO:1895;
TLRSPLGDRLNVEVDTAPTVDL,   SEQ ID NO:1896;
LRCQLGDRLNVEVDAAPTVDLN,   SEQ ID NO:1897;
LRCQLGDRLNVEVDTAPTVDLN,   SEQ ID NO:1898;
LRCPLGDRLNVEVDAAPTVDLN,   SEQ ID NO:1899;
LRCPLGDRLNVEVDTAPTVDLN,   SEQ ID NO:1900;
LRSQLGDRLNVEVDAAPTVDLN,   SEQ ID NO:1901;
LRSQLGDRLNVEVDTAPTVDLN,   SEQ ID NO:1902;
LRSPLGDRLNVEVDAAPTVDLN,   SEQ ID NO:1903;
LRSPLGDRLNVEVDTAPTVDLN,   SEQ ID NO:1904;
RCQLGDRLNVEVDAAPTVDLNQ,   SEQ ID NO:1905;
RSQLGDRLNVEVDAAPTVDLNQ,   SEQ ID NO:1906
RCPLGDRLNVEVDAAPTVDLNQ,   SEQ ID NO:1907
RSPLGDRLNVEVDAAPTVDLNQ,   SEQ ID NO:1908
RCQLGDRLNVEVDTAPTVDLNQ,   SEQ ID NO:1909
RSQLGDRLNVEVDTAPTVDLNQ,   SEQ ID NO:1910
RCPLGDRLNVEVDTAPTVDLNQ,   SEQ ID NO:1911
RSPLGDRLNVEVDTAPTVDLNQ,   SEQ ID NO:1912
RCQLGDRLNVEVDAAPTVDLNR,   SEQ ID NO:1913
RSQLGDRLNVEVDAAPTVDLNR,   SEQ ID NO:1914
RCPLGDRLNVEVDAAPTVDLNR,   SEQ ID NO:1915
RSPLGDRLNVEVDAAPTVDLNR,   SEQ ID NO:1916
RCQLGDRLNVEVDTAPTVDLNR,   SEQ ID NO:1917
RSQLGDRLNVEVDTAPTVDLNR,   SEQ ID NO:1918
RCPLGDRLNVEVDTAPTVDLNR,   SEQ ID NO:1919
RSPLGDRLNVEVDTAPTVDLNR,   SEQ ID NO:1920
CQLGDRLNVEVDAAPTVDLNQV,   SEQ ID NO:1921
SQLGDRLNVEVDAAPTVDLNQV,   SEQ ID NO:1922
CPLGDRLNVEVDAAPTVDLNQV,   SEQ ID NO:1923
SPLGDRLNVEVDAAPTVDLNQV,   SEQ ID NO:1924
CQLGDRLNVEVDTAPTVDLNQV,   SEQ ID NO:1925
SQLGDRLNVEVDTAPTVDLNQV,   SEQ ID NO:1926
CPLGDRLNVEVDTAPTVDLNQV,   SEQ ID NO:1927
SPLGDRLNVEVDTAPTVDLNQV,   SEQ ID NO:1928
CQLGDRLNVEVDAAPTVDLNRV,   SEQ ID NO:1929
SQLGDRLNVEVDAAPTVDLNRV,   SEQ ID NO:1930
CPLGDRLNVEVDAAPTVDLNRVL,  SEQ ID NO:1931
SPLGDRLNVEVDAAPTVDLNRV,   SEQ ID NO:1932
CQLGDRLNVEVDTAPTVDLNRV,   SEQ ID NO:1933
SQLGDRLNVEVDTAPTVDLNRV,   SEQ ID NO:1934
CPLGDRLNVEVDTAPTVDLNRV,   SEQ ID NO:1935
SPLGDRLNVEVDTAPTVDLNRV,   SEQ ID NO:1936
QLGDRLNVEVDAAPTVDLNQVL,   SEQ ID NO:1937;
QLGDRLNVEVDAAPTVDLNRVL,   SEQ ID NO:1938;
QLGDRLNVEVDTAPTVDLNQVL,   SEQ ID NO:1939;
QLGDRLNVEVDTAPTVDLNRVL,   SEQ ID NO:1940;
PLGDRLNVEVDAAPTVDLNQVL,   SEQ ID NO:1941;
PLGDRLNVEVDAAPTVDLNRVL,   SEQ ID NO:1942;
PLGDRLNVEVDTAPTVDLNQVL,   SEQ ID NO:1943;
```

-continued

```
PLGDRLNVEVDTAPTVDLNRVL,   SEQ ID NO:1944;
LGDRLNVEVDAAPTVDLNQVLN,   SEQ ID NO:1945;
LGDRLNVEVDAAPTVDLNRVLN,   SEQ ID NO:1946;
LGDRLNVEVDTAPTVDLNQVLN,   SEQ ID NO:1947;
LGDRLNVEVDTAPTVDLNRVLN,   SEQ ID NO:1948;
GDRLNVEVDAAPTVDLNQVLNE,   SEQ ID NO:1949;
GDRLNVEVDAAPTVDLNRVLNE,   SEQ ID NO:1950;
GDRLNVEVDTAPTVDLNQVLNE,   SEQ ID NO:1951;
GDRLNVEVDTAPTVDLNRVLNE,   SEQ ID NO:1952;
DRLNVEVDAAPTVDLNQVLNET,   SEQ ID NO:1953;
DRLNVEVDAAPTVDLNRVLNET,   SEQ ID NO:1954;
DRLNVEVDTAPTVDLNQVLNET,   SEQ ID NO:1955;
DRLNVEVDTAPTVDLNRVLNET,   SEQ ID NO:1956;
RLNVEVDAAPTVDLNQVLNETR,   SEQ ID NO:1957;
RLNVEVDAAPTVDLNRVLNETR,   SEQ ID NO:1958;
RLNVEVDTAPTVDLNQVLNETR,   SEQ ID NO:1959;
RLNVEVDTAPTVDLNRVLNETR,   SEQ ID NO:1960;
LNVEVDAAPTVDLNQVLNETRS,   SEQ ID NO:1961;
LNVEVDAAPTVDLNQVLNETRN,   SEQ ID NO:1962;
LNVEVDAAPTVDLNRVLNETRS,   SEQ ID NO:1963;
LNVEVDAAPTVDLNRVLNETRN,   SEQ ID NO:1964;
LNVEVDTAPTVDLNQVLNETRS,   SEQ ID NO:1965;
LNVEVDTAPTVDLNQVLNETRN,   SEQ ID NO:1966;
LNVEVDTAPTVDLNRVLNETRS,   SEQ ID NO:1967;
LNVEVDTAPTVDLNRVLNETRN,   SEQ ID NO:1968;
NVEVDAAPTVDLNQVLNETRSQ,   SEQ ID NO:1969;
NVEVDAAPTVDLNQVLNETRNQ,   SEQ ID NO:1970;
NVEVDAAPTVDLNRVLNETRSQ,   SEQ ID NO:1971;
NVEVDAAPTVDLNRVLNETRNQ,   SEQ ID NO:1972;
NVEVDTAPTVDLNQVLNETRSQ,   SEQ ID NO:1973;
NVEVDTAPTVDLNQVLNETRNQ,   SEQ ID NO:1974;
NVEVDTAPTVDLNRVLNETRSQ,   SEQ ID NO:1975;
NVEVDTAPTVDLNRVLNETRNQ,   SEQ ID NO:1976;
EVNTLRCQLGDRLNVEVDAAPTV,  SEQ ID NO:1977;
EVNTLRCQLGDRLNVEVDTAPTV,  SEQ ID NO:1978;
EVNTLRCPLGDRLNVEVDAAPTV,  SEQ ID NO:1979;
EVNTLRCPLGDRLNVEVDTAPTV,  SEQ ID NO:1980;
EVNTLRSQLGDRLNVEVDAAPTV,  SEQ ID NO:1981;
EVNTLRSQLGDRLNVEVDTAPTV,  SEQ ID NO:1982;
EVNTLRSPLGDRLNVEVDAAPTV,  SEQ ID NO:1983;
EVNTLRSPLGDRLNVEVDTAPTV,  SEQ ID NO:1984;
VNTLRCQLGDRLNVEVDAAPTVD,  SEQ ID NO:1985
VNTLRSQLGDRLNVEVDAAPTVD,  SEQ ID NO:1986
VNTLRCPLGDRLNVEVDAAPTVD,  SEQ ID NO:1987
VNTLRSPLGDRLNVEVDAAPTVD,  SEQ ID NO:1988
VNTLRCQLGDRLNVEVDTAPTVD,  SEQ ID NO:1989
VNTLRSQLGDRLNVEVDTAPTVD,  SEQ ID NO:1990
VNTLRCPLGDRLNVEVDTAPTVD,  SEQ ID NO:1991
VNTLRSPLGDRLNVEVDTAPTVD,  SEQ ID NO:1992
NTLRCQLGDRLNVEVDAAPTVDL,  SEQ ID NO:1993      NTLRSQLGDRLNVEVDAAPTVDL,  SEQ ID NO:1994
NTLRCPLGDRLNVEVDAAPTVDL,  SEQ ID NO:1995      NTLRSPLGDRLNVEVDAAPTVDL,  SEQ ID NO:1996
NTLRCQLGDRLNVEVDTAPTVDL,  SEQ ID NO:1997      NTLRSQLGDRLNVEVDTAPTVDL,  SEQ ID NO:1998
NTLRCPLGDRLNVEVDTAPTVDL,  SEQ ID NO:1999      NTLRSPLGDRLNVEVDTAPTVDL,  SEQ ID NO:2000
TLRCQLGDRLNVEVDAAPTVDLN,  SEQ ID NO:2001      TLRSQLGDRLNVEVDAAPTVDLN,  SEQ ID NO:2002
TLRCPLGDRLNVEVDAAPTVDLN,  SEQ ID NO:2003      TLRSPLGDRLNVEVDAAPTVDLN,  SEQ ID NO:2004
TLRCQLGDRLNVEVDTAPTVDLN,  SEQ ID NO:2005      TLRSQLGDRLNVEVDTAPTVDLN,  SEQ ID NO:2006
TLRCPLGDRLNVEVDTAPTVDLN,  SEQ ID NO:2007      TLRSPLGDRLNVEVDTAPTVDLN,  SEQ ID NO:2008
LRCQLGDRLNVEVDAAPTVDLNQ,  SEQ ID NO:2009      LRSQLGDRLNVEVDAAPTVDLNQ,  SEQ ID NO:2010
LRCPLGDRLNVEVDAAPTVDLNQ,  SEQ ID NO:2011      LRSPLGDRLNVEVDAAPTVDLNQ,  SEQ ID NO:2012
LRCQLGDRLNVEVDTAPTVDLNQ,  SEQ ID NO:2013      LRSQLGDRLNVEVDTAPTVDLNQ,  SEQ ID NO:2014
LRCPLGDRLNVEVDTAPTVDLNQ,  SEQ ID NO:2015      LRSPLGDRLNVEVDTAPTVDLNQ,  SEQ ID NO:2016
LRCQLGDRLNVEVDAAPTVDLNR,  SEQ ID NO:2017      LRSQLGDRLNVEVDAAPTVDLNR,  SEQ ID NO:2018
LRCPLGDRLNVEVDAAPTVDLNR,  SEQ ID NO:2019      LRSPLGDRLNVEVDAAPTVDLNR,  SEQ ID NO:2020
LRCQLGDRLNVEVDTAPTVDLNR,  SEQ ID NO:2021      LRSQLGDRLNVEVDTAPTVDLNR,  SEQ ID NO:2022
LRCPLGDRLNVEVDTAPTVDLNR,  SEQ ID NO:2023      LRSPLGDRLNVEVDTAPTVDLNR,  SEQ ID ID:2024
RCQLGDRLNVEVDAAPTVDLNQV,  SEQ ID NO:2025      RSQLGDRLNVEVDAAPTVDLNQV,  SEQ ID NO:2026
RCPLGDRLNVEVDAAPTVDLNQV,  SEQ ID NO:2027      RSPLGDRLNVEVDAAPTVDLNQV,  SEQ ID NO:2028
RCQLGDRLNVEVDTAPTVDLNQV,  SEQ ID NO:2029      RSQLGDRLNVEVDTAPTVDLNQV,  SEQ ID NO:2030
RCPLGDRLNVEVDTAPTVDLNQV,  SEQ ID NO:2031      RSPLGDRLNVEVDTAPTVDLNQV,  SEQ ID NO:2032
RCQLGDRLNVEVDAAPTVDLNRV,  SEQ ID NO:2033      RSQLGDRLNVEVDAAPTVDLNRV,  SEQ ID NO:2034
RCPLGDRLNVEVDAAPTVDLNRV,  SEQ ID NO:2035      RSPLGDRLNVEVDAAPTVDLNRV,  SEQ ID NO:2036
RCQLGDRLNVEVDTAPTVDLNRV,  SEQ ID NO:2037      RSQLGDRLNVEVDTAPTVDLNRV,  SEQ ID NO:2038
RCPLGDRLNVEVDTAPTVDLNRV,  SEQ ID NO:2039      RSPLGDRLNVEVDTAPTVDLNRV,  SEQ ID NO:2040
CQLGDRLNVEVDAAPTVDLNQVL,  SEQ ID NO:2041      SQLGDRLNVEVDAAPTVDLNQVL,  SEQ ID NO:2042
CPLGDRLNVEVDAAPTVDLNQVL,  SEQ ID NO:2043      SPLGDRLNVEVDAAPTVDLNQVL,  SEQ ID NO:2044
CQLGDRLNVEVDTAPTVDLNQVL,  SEQ ID NO:2045      SQLGDRLNVEVDTAPTVDLNQVL,  SEQ ID NO:2046
CPLGDRLNVEVDTAPTVDLNQVL,  SEQ ID NO:2047      SPLGDRLNVEVDTAPTVDLNQVL,  SEQ ID NO:2048
CQLGDRLNVEVDAAPTVDLNRVL,  SEQ ID NO:2049      SQLGDRLNVEVDAAPTVDLNRVL,  SEQ ID NO:2050
CPLGDRLNVEVDAAPTVDLNRVL,  SEQ ID NO:2051      SPLGDRLNVEVDAAPTVDLNRVL,  SEQ ID NO:2052
CQLGDRLNVEVDTAPTVDLNRVL,  SEQ ID NO:2053      SQLGDRLNVEVDTAPTVDLNRVL,  SEQ ID NO:2054
```

-continued

```
CPLGDRLNVEVDTAPTVDLNRVL,   SEQ ID NO:2055   SPLGDRLNVEVDTAPTVDLNRVL,   SEQ ID NO:2056
QLGDRLNVEVDAAPTVDLNQVLN,   SEQ ID NO:2057   PLGDRLNVEVDAAPTVDLNQVLN,   SEQ ID NO:2058
QLGDRLNVEVDTAPTVDLNQVLN,   SEQ ID NO:2059   PLGDRLNVEVDTAPTVDLNQVLN,   SEQ ID NO:2060
QLGDRLNVEVDAAPTVDLNRVLN,   SEQ ID NO:2061   PLGDRLNVEVDAAPTVDLNRVLN,   SEQ ID NO:2062
QLGDRLNVEVDTAPTVDLNRVLN,   SEQ ID NO:2063   PLGDRLNVEVDTAPTVDLNRVLN,   SEQ ID NO:2064
LGDRLNVEVDAAPTVDLNQVLNE,   SEQ ID NO:2065;  LGDRLNVEVDAAPTVDLNRVLNE,   SEQ ID NO:2066;
LGDRLNVEVDTAPTVDLNQVLNE,   SEQ ID NO:2067;  LGDRLNVEVDTAPTVDLNRVLNE,   SEQ ID NO:2068;
GDRLNVEVDAAPTVDLNQVLNET,   SEQ ID NO:2069;  GDRLNVEVDAAPTVDLNRVLNET,   SEQ ID NO:2070;
GDRLNVEVDTAPTVDLNQVLNET,   SEQ ID NO:2071;  GDRLNVEVDTAPTVDLNRVLNET,   SEQ ID NO:2072;
DRLNVEVDAAPTVDLNQVLNETR,   SEQ ID NO:2073;  DRLNVEVDAAPTVDLNRVLNETR,   SEQ ID NO:2074;
DRLNVEVDTAPTVDLNQVLNETR,   SEQ ID NO:2075;  DRLNVEVDTAPTVDLNRVLNETR,   SEQ ID NO:2076;
RLNVEVDAAPTVDLNQVLNETRS,   SEQ ID NO:2077   RLNVEVDTAPTVDLNQVLNETRS,   SEQ ID NO:2078
RLNVEVDAAPTVDLNRVLNETRS,   SEQ ID NO:2079   RLNVEVDTAPTVDLNRVLNETRS,   SEQ ID NO:2080
RLNVEVDAAPTVDLNQVLNETRN,   SEQ ID NO:2081   RLNVEVDTAPTVDLNQVLNETRN,   SEQ ID NO:2082
RLNVEVDAAPTVDLNRVLNETRN,   SEQ ID NO:2083   RLNVEVDTAPTVDLNRVLNETRN,   SEQ ID NO:2084
LNVEVDAAPTVDLNQVLNETRSQ,   SEQ ID NO:2085   LNVEVDTAPTVDLNQVLNETRSQ,   SEQ ID NO:2086
LNVEVDAAPTVDLNRVLNETRSQ,   SEQ ID NO:2087   LNVEVDTAPTVDLNRVLNETRSQ,   SEQ ID NO:2088
LNVEVDAAPTVDLNQVLNETRNQ,   SEQ ID NO:2089   LNVEVDTAPTVDLNQVLNETRNQ,   SEQ ID NO:2090
LNVEVDAAPTVDLNRVLNETRNQ,   SEQ ID NO:2091   LNVEVDTAPTVDLNRVLNETRNQ,   SEQ ID NO:2092
NVEVDAAPTVDLNQVLNETRSQY,   SEQ ID NO:2093   NVEVDTAPTVDLNQVLNETRSQY,   SEQ ID NO:2094
NVEVDAAPTVDLNRVLNETRSQY,   SEQ ID NO:2095   NVEVDTAPTVDLNRVLNETRSQY,   SEQ ID NO:2096
NVEVDAAPTVDLNQVLNETRNQY,   SEQ ID NO:2097   NVEVDTAPTVDLNQVLNETRNQY,   SEQ ID NO:2098
NVEVDAAPTVDLNRVLNETRNQY,   SEQ ID NO:2099   NVEVDTAPTVDLNRVLNETRNQY,   SEQ ID NO:3000
VEVDAAPTVDLNQVLNETRSQYE,   SEQ ID NO:3001   VEVDTAPTVDLNQVLNETRSQYE,   SEQ ID NO:3002
VEVDANPTVDLNRVLNETRSQYE,   SEQ ID NO:3003   VEVDTAPTVDLNRVLNETRSQYE,   SEQ ID NO:3004
VEVDAAPTVDLNQVLNETRNQYE,   SEQ ID NO:3005   VEVDTAPTVDLNQVLNETRNQYE,   SEQ ID NO:3006
VEVDAAPTVDLNRVLNETRNQYE,   SEQ ID NO:3007   VEVDTAPTVDLNRVLNETRNQYE,   SEQ ID NO:3008
EVDAAPTVDLNQVLNETRSQYEA,   SEQ ID NO:3009   EVDTAPTVDLNQVLNETRSQYEA,   SEQ ID NO:3010
EVDAAPTVDLNRVLNETRSQYEA,   SEQ ID NO:3011   EVDTAPTVDLNRVLNETRSQYEA,   SEQ ID NO:3012
EVDAAPTVDLNQVLNETRNQYEA,   SEQ ID NO:3013   EVDTAPTVDLNQVLNETRNQYEA,   SEQ ID NO:3014
EVDAAPTVDLNRVLNETRNQYEA,   SEQ ID NO:3015   EVDTAPTVDLNRVLNETRNQYEA,   SEQ ID NO:3016
VDAAPTVDLNQVLNETRSQYEAL,   SEQ ID NO:3017   VDTAPTVDLNQVLNETRSQYEAL,   SEQ ID NO:3018
VDAAPTVDLNRVLNETRSQYEAL,   SEQ ID NO:3019   VDTAPTVDLNRVLNETRSQYEAL,   SEQ ID NO:3020
VDAAPTVDLNQVLNETRNQYEAL,   SEQ ID NO:3021   VDTAPTVDLNQVLNETRNQYEAL,   SEQ ID NO:3022
VDAAPTVDLNRVLNETRNQYEAL,   SEQ ID NO:3023   VDTAPTVDLNRVLNETRNQYEAL,   SEQ ID NO:3024
EVNTLRCQLGDRLNVEVDAAPTVD, SEQ ID NO:3025   EVNTLRSQLGDRLNVEVDAAPTVD, SEQ ID NO:3026
EVNTLRCPLGDRLNVEVDAAPTVD, SEQ ID NO:3027   EVNTLRSPLGDRLNVEVDAAPTVD, SEQ ID NO:3028
EVNTLRCQLGDRLNVEVDTAPTVD, SEQ ID NO:3029   EVNTLRSQLGDRLNVEVDTAPTVD, SEQ ID NO:3030
EVNTLRCPLGDRLNVEVDTAPTVD, SEQ ID NO:3031   EVNTLRSPLGDRLNVEVDTAPTVD, SEQ ID NO:3032
VNTLRCQLGDRLNVEVDAAPTVDL, SEQ ID NO:3033   VNTLRSQLGDRLNVEVDAAPTVDL, SEQ ID NO:3034
VNTLRCPLGDRLNVEVDAAPTVDL, SEQ ID NO:3035   VNTLRSPLGDRLNVEVDAAPTVDL, SEQ ID NO:3036
VNTLRCQLGDRLNVEVDTAPTVDL, SEQ ID NO:3037   VNTLRSQLGDRLNVEVDTAPTVDL, SEQ ID NO:3038
VNTLRCPLGDRLNVEVDTAPTVDL, SEQ ID NO:3039   VNTLRSPLGDRLNVEVDTAPTVDL, SEQ ID NO:3040
NTLRCQLGDRLNVEVDAAPTVDLN, SEQ ID NO:3041   NTLRSQLGDRLNVEVDAAPTVDLN, SEQ ID NO:3042
NTLRCPLGDRLNVEVDAAPTVDLN, SEQ ID NO:3043   NTLRSPLGDRLNVEVDAAPTVDLN, SEQ ID NO:3044
NTLRCQLGDRLNVEVDTAPTVDLN, SEQ ID NO:3045   NTLRSQLGDRLNVEVDTAPTVDLN, SEQ ID NO:3046
NTLRCPLGDRLNVEVDTAPTVDLN, SEQ ID NO:3047   NTLRSPLGDRLNVEVDTAPTVDLN, SEQ ID NO:3048
TLRCQLGDRLNVEVDAAPTVDLNQ, SEQ ID NO:3049   TLRSQLGDRLNVEVDAAPTVDLNQ, SEQ ID NO:3050
TLRCPLGDRLNVEVDAAPTVDLNQ, SEQ ID NO:3051   TLRSPLGDRLNVEVDAAPTVDLNQ, SEQ ID NO:3052
TLRCQLGDRLNVEVDTAPTVDLNQ, SEQ ID NO:3053   TLRSQLGDRLNVEVDTAPTVDLNQ, SEQ ID NO:3054
TLRCPLGDRLNVEVDTAPTVDLNQ, SEQ ID NO:3055   TLRSPLGDRLNVEVDTAPTVDLNQ, SEQ ID NO:3056
TLRCQLGDRLNVEVDAAPTVDLNR, SEQ ID NO:3057   TLRSQLGDRLNVEVDAAPTVDLNR, SEQ ID NO:3058
TLRCPLGDRLNVEVDAAPTVDLNR, SEQ ID NO:3059   TLRSPLGDRLNVEVDAAPTVDLNR, SEQ ID NO:3060
TLRCQLGDRLNVEVDTAPTVDLNR, SEQ ID NO:3061   TLRSQLGDRLNVEVDTAPTVDLNR, SEQ ID NO:3062
TLRCPLGDRLNVEVDTAPTVDLNR, SEQ ID NO:3063   TLRSPLGDRLNVEVDTAPTVDLNR, SEQ ID NO:3064
LRCQLGDRLNVEVDAAPTVDLNQV, SEQ ID NO:3065   LRSQLGDRLNVEVDAAPTVDLNQV, SEQ ID NO:3066
LRCPLGDRLNVEVDAAPTVDLNQV, SEQ ID NO:3067   LRSPLGDRLNVEVDAAPTVDLNQV, SEQ ID NO:3068
LRCQLGDRLNVEVDTAPTVDLNQV, SEQ ID NO:3069   LRSQLGDRLNVEVDTAPTVDLNQV, SEQ ID NO:3070
LRCPLGDRLNVEVDTAPTVDLNQV, SEQ ID NO:3071   LRSPLGDRLNVEVDTAPTVDLNQV, SEQ ID NO:3072
LRCQLGDRLNVEVDAAPTVDLNRV, SEQ ID NO:3073   LRSQLGDRLNVEVDAAPTVDLNRV, SEQ ID NO:3074
LRCPLGDRLNVEVDAAPTVDLNRV, SEQ ID NO:3075   LRSPLGDRLNVEVDAAPTVDLNRV, SEQ ID NO:3076
LRCQLGDRLNVEVDTAPTVDLNRV, SEQ ID NO:3077   LRSQLGDRLNVEVDTAPTVDLNRV, SEQ ID NO:3078
LRCPLGDRLNVEVDTAPTVDLNRV, SEQ ID NO:3079   LRSPLGDRLNVEVDTAPTVDLNRV, SEQ ID NO:3080
RCQLGDRLNVEVDAAPTVDLNQVL, SEQ ID NO:3081   RSQLGDRLNVEVDAAPTVDLNQVL, SEQ ID NO:3082
RCPLGDRLNVEVDAAPTVDLNQVL, SEQ ID NO:3083   RSPLGDRLNVEVDAAPTVDLNQVL, SEQ ID NO:3084
RCQLGDRLNVEVDTAPTVDLNQVL, SEQ ID NO:3085   RSQLGDRLNVEVDTAPTVDLNQVL, SEQ ID NO:3086
RCPLGDRLNVEVDTAPTVDLNQVL, SEQ ID NO:3087   RSPLGDRLNVEVDTAPTVDLNQVL, SEQ ID NO:3088
RCQLGDRLNVEVDAAPTVDLNRVL, SEQ ID NO:3089   RSQLGDRLNVEVDAAPTVDLNRVL, SEQ ID NO:3090
RCPLGDRLNVEVDAAPTVDLNRVL, SEQ ID NO:3091   RSPLGDRLNVEVDAAPTVDLNRVL, SEQ ID NO:3092
RCQLGDRLNVEVDTAPTVDLNRVL, SEQ ID NO:3093   RSQLGDRLNVEVDTAPTVDLNRVL, SEQ ID NO:3094
RCPLGDRLNVEVDTAPTVDLNRVL, SEQ ID NO:3095   RSPLGDRLNVEVDTAPTVDLNRVL, SEQ ID NO:3096
CQLGDRLNVEVDAAPTVDLNQVLN, SEQ ID NO:3097   SQLGDRLNVEVDAAPTVDLNQVLN, SEQ ID NO:3098
CPLGDRLNVEVDAAPTVDLNQVLN, SEQ ID NO:3099   SPLGDRLNVEVDAAPTVDLNQVLN, SEQ ID NO:4000
CQLGDRLNVEVDTAPTVDLNQVLN, SEQ ID NO:4001   SQLGDRLNVEVDTAPTVDLNQVLN, SEQ ID NO:4002
CPLGDRLNVEVDTAPTVDLNQVLN, SEQ ID NO:4003   SPLGDRLNVEVDTAPTVDLNQVLN, SEQ ID NO:4004
CQLGDRLNVEVDAAPTVDLNRVLN, SEQ ID NO:4005   SQLGDRLNVEVDAAPTVDLNRVLN, SEQ ID NO:4006
CPLGDRLNVEVDAAPTVDLNRVLN, SEQ ID NO:4007   SPLGDRLNVEVDAAPTVDLNRVLN, SEQ ID NO:4008
CQLGDRLNVEVDTAPTVDLNRVLN, SEQ ID NO:4009   SQLGDRLNVEVDTAPTVDLNRVLN, SEQ ID NO:4010
CPLGDRLNVEVDTAPTVDLNRVLN, SEQ ID NO:4011   SPLGDRLNVEVDTAPTVDLNRVLN, SEQ ID NO:4012
QLGDRLNVEVDAAPTVDLNQVLNE, SEQ ID NO:4013   PLGDRLNVEVDAAPTVDLNQVLNE, SEQ ID NO:4014
```

-continued

```
QLGDRLNVEVDTAPTVDLNQVLNE, SEQ ID NO:4015    PLGDRLNVEVDTAPTVDLNQVLNE, SEQ ID NO:4016
QLGDRLNVEVDAAPTVDLNRVLNE, SEQ ID NO:4017    PLGDRLNVEVDAAPTVDLNRVLNE, SEQ ID NO:4018
QLGDRLNVEVDTAPTVDLNRVLNE, SEQ ID NO:4019    PLGDRLNVEVDTAPTVDLNRVLNE, SEQ ID NO:4020
LGDRLNVEVDAAPTVDLNQVLNET, SEQ ID NO:4021;   LGDRLNVEVDAAPTVDLNRVLNET, SEQ ID
                                                                     NO:4022;
LGDRLNVEVDTAPTVDLNQVLNET, SEQ ID NO:4023;   LGDRLNVEVDTAPTVDLNRVLNET, SEQ ID
                                                                     NO:4024;
GDRLNVEVDAAPTVDLNQVLNETR, SEQ ID NO:4025;   GDRLNVEVDAAPTVDLNRVLNETR, SEQ ID
                                                                     NO:4026;
GDRLNVEVDTAPTVDLNQVLNETR, SEQ ID NO:4027;   GDRLNVEVDTAPTVDLNRVLNETR, SEQ ID
                                                                     NO:4028;
DRLNVEVDAAPTVDLNQVLNETRS, SEQ ID NO:4029    DRLNVEVDTAPTVDLNQVLNETRS, SEQ ID NO:4030
DRLNVEVDAAPTVDLNRVLNETRS, SEQ ID NO:4031    DRLNVEVDTAPTVDLNRVLNETRS, SEQ ID NO:4032
DRLNVEVDAAPTVDLNQVLNETRN, SEQ ID NO:4033    DRLNVEVDTAPTVDLNQVLNETRN, SEQ ID NO:4034
DRLNVEVDAAPTVDLNRVLNETRN, SEQ ID NO:4035    DRLNVEVDTAPTVDLNRVLNETRN, SEQ ID NO:4036
RLNVEVDAAPTVDLNQVLNETRSQ, SEQ ID NO:4037
RLNVEVDTAPTVDLNQVLNETRSQ, SEQ ID NO:4038
RLNVEVDAAPTVDLNRVLNETRSQ, SEQ ID NO:4039
RLNVEVDTAPTVDLNRVLNETRSQ, SEQ ID NO:4040
RLNVEVDAAPTVDLNQVLNETRNQ, SEQ ID NO:4041
RLNVEVDTAPTVDLNQVLNETRNQ, SEQ ID NO:4042
RLNVEVDAAPTVDLNRVLNETRNQ, SEQ ID NO:4043
RLNVEVDTAPTVDLNRVLNETRNQ, SEQ ID NO:4044
LNVEVDAAPTVDLNQVLNETRSQY, SEQ ID NO:4045
LNVEVDTAPTVDLNQVLNETRSQY, SEQ ID NO:4046
LNVEVDAAPTVDLNRVLNETRSQY, SEQ ID NO:4047
LNVEVDTAPTVDLNRVLNETRSQY, SEQ ID NO:4048
LNVEVDAAPTVDLNQVLNETRNQY, SEQ ID NO:4049
LNVEVDTAPTVDLNQVLNETRNQY, SEQ ID NO:4050
LNVEVDAAPTVDLNRVLNETRNQY, SEQ ID NO:4051
LNVEVDTAPTVDLNRVLNETRNQY, SEQ ID NO:4052
NVEVDAAPTVDLNQVLNETRSQYE, SEQ ID NO:4053
NVEVDTAPTVDLNQVLNETRSQYE, SEQ ID NO:4054
NVEVDAAPTVDLNRVLNETRSQYE, SEQ ID NO:4055
NVEVDTAPTVDLNRVLNETRSQYE, SEQ ID NO:4056
NVEVDAAPTVDLNQVLNETRNQYE, SEQ ID NO:4057
NVEVDTAPTVDLNQVLNETRNQYE, SEQ ID NO:4058
NVEVDAAPTVDLNRVLNETRNQYE, SEQ ID NO:4059
NVEVDTAPTVDLNRVLNETRNQYE, SEQ ID NO:4060
VEVDAAPTVDLNQVLNETRSQYEA, SEQ ID NO:4061
VEVDTAPTVDLNQVLNETRSQYEA, SEQ ID NO:4062
VEVDAAPTVDLNRVLNETRSQYEA, SEQ ID NO:4063
VEVDTAPTVDLNRVLNETRSQYEA, SEQ ID NO:4064
VEVDAAPTVDLNQVLNETRNQYEA, SEQ ID NO:4065
VEVDTAPTVDLNQVLNETRNQYEA, SEQ ID NO:4066
VEVDAAPTVDLNRVLNETRNQYEA, SEQ ID NO:4067
VEVDTAPTVDLNRVLNETRNQYEA, SEQ ID NO:4068
EVDAAPTVDLNQVLNETRSQYEAL, SEQ ID NO:4069
EVDTAPTVDLNQVLNETRSQYEAL, SEQ ID NO:4070
EVDAAPTVDLNRVLNETRSQYEAL, SEQ ID NO:4071
EVDTAPTVDLNRVLNETRSQYEAL, SEQ ID NO:4072
EVDAAPTVDLNQVLNETRNQYEAL, SEQ ID NO:4073
EVDTAPTVDLNQVLNETRNQYEAL, SEQ ID NO:4074
EVDAAPTVDLNRVLNETRNQYEAL, SEQ ID NO:4075
EVDTAPTVDLNRVLNETRNQYEAL, SEQ ID NO:4076
EVNTLRCQLGDRLNVEVDAAPTVDL, SEQ ID NO:4077
EVNTLRSQLGDRLNVEVDAAPTVDL, SEQ ID NO:4078
EVNTLRCPLGDRLNVEVDAAPTVDL, SEQ ID NO:4079
EVNTLRSPLGDRLNVEVDAAPTVDL, SEQ ID NO:4080
EVNTLRCQLGDRLNVEVDTAPTVDL, SEQ ID NO:4081
EVNTLRSQLGDRLNVEVDTAPTVDL, SEQ ID NO:4082
EVNTLRCPLGDRLNVEVDTAPTVDL, SEQ ID NO:4083
EVNTLRSPLGDRLNVEVDTAPTVDL, SEQ ID NO:4084
VNTLRCQLGDRLNVEVDAAPTVDLN, SEQ ID NO:4085
VNTLRSQLGDRLNVEVDAAPTVDLN, SEQ ID NO:4086
VNTLRCPLGDRLNVEVDAAPTVDLN, SEQ ID NO:4087
VNTLRSPLGDRLNVEVDANPTVDLN, SEQ ID NO:4088
VNTLRCQLGDRLNVEVDTAPTVDLN, SEQ ID NO:4089
VNTLRSQLGDRLNVEVDTAPTVDLN, SEQ ID NO:4090
VNTLRCPLGDRLNVEVDTAPTVDLN, SEQ ID NO:4091
VNTLRSPLGDRLNVEVDTAPTVDLN, SEQ ID NO:4091
NTLRCQLGDRLNVEVDAAPTVDLNQ, SEQ ID NO:4093
NTLRSQLGDRLNVEVDAAPTVDLNQ, SEQ ID NO:4094
NTLRCPLGDRLNVEVDAAPTVDLNQ, SEQ ID NO:4095
NTLRSPLGDRLNVEVDAAPTVDLNQ, SEQ ID NO:4096
NTLRCQLGDRLNVEVDTAPTVDLNQ, SEQ ID NO:4097
NTLRSQLGDRLNVEVDTAPTVDLNQ, SEQ ID NO:4098
NTLRCPLGDRLNVEVDTAPTVDLNQ, SEQ ID NO:4099
NTLRSPLGDRLNVEVDTAPTVDLNQ, SEQ ID NO:4100
NTLRCQLGDRLNVEVDAAPTVDLNR, SEQ ID NO:4101
```

-continued

```
NTLRSQLGDRLNVEVDAAPTVDLNR,   SEQ ID NO:4102
NTLRCPLGDRLNVEVDAAPTVDLNR,   SEQ ID NO:4103
NTLRSPLGDRLNVEVDAAPTVDLNR,   SEQ ID NO:4104
NTLRCQLGDRLNVEVDTAPTVDLNR,   SEQ ID NO:4105
NTLRSQLGDRLNVEVDTAPTVDLNR,   SEQ ID NO:4106
NTLRCPLGDRLNVEVDTAPTVDLNR,   SEQ ID NO:4107
NTLRSPLGDRLNVEVDTAPTVDLNR,   SEQ ID NO:4108
TLRCQLGDRLNVEVDAAPTVDLNQV,   SEQ ID NO:4109
TLRSQLGDRLNVEVDAAPTVDLNQV,   SEQ ID NO:4110
TLRCPLGDRLNVEVDAAPTVDLNQV,   SEQ ID NO:4111
TLRSPLGDRLNVEVDAAPTVDLNQV,   SEQ ID NO:4112
TLRCQLGDRLNVEVDTAPTVDLNQV,   SEQ ID NO:4113
TLRSQLGDRLNVEVDTAPTVDLNQV,   SEQ ID NO:4114
TLRCPLGDRLNVEVDTAPTVDLNQV,   SEQ ID NO:4115
TLRSPLGDRLNVEVDTAPTVDLNQV,   SEQ ID NO:4116
TLRCQLGDRLNVEVDAAPTVDLNRV,   SEQ ID NO:4117
TLRSQLGDRLNVEVDAAPTVDLNRV,   SEQ ID NO:4118
TLRCPLGDRLNVEVDAAPTVDLNRV,   SEQ ID NO:4119
TLRSPLGDRLNVEVDAAPTVDLNRV,   SEQ ID NO:4120
TLRCQLGDRLNVEVDTAPTVDLNRV,   SEQ ID NO:4121
TLRSQLGDRLNVEVDTAPTVDLNRV,   SEQ ID NO:4122
TLRCPLGDRLNVEVDTAPTVDLNRV,   SEQ ID NO:4123
TLRSPLGDRLNVEVDTAPTVDLNRV,   SEQ ID NO:4124
LRCQLGDRLNVEVDAAPTVDLNQVL,   SEQ ID NO:4125
LRSQLGDRLNVEVDAAPTVDLNQVL,   SEQ ID NO:4126
LRCPLGDRLNVEVDAAPTVDLNQVL,   SEQ ID NO:4127
LRSPLGDRLNVEVDAAPTVDLNQVL,   SEQ ID NO:4128
LRCQLGDRLNVEVDTAPTVDLNQVL,   SEQ ID NO:4129
LRSQLGDRLNVEVDTAPTVDLNQVL,   SEQ ID NO:4130
LRCPLGDRLNVEVDTAPTVDLNQVL,   SEQ ID NO:4131
LRSPLGDRLNVEVDTAPTVDLNQVL,   SEQ ID NO:4132
LRCQLGDRLNVEVDAAPTVDLNRVL,   SEQ ID NO:4133
LRSQLGDRLNVEVDAAPTVDLNRVL,   SEQ ID NO:4134
LRCPLGDRLNVEVDAAPTVDLNRVL,   SEQ ID NO:4135
LRSPLGDRLNVEVDAAPTVDLNRVL,   SEQ ID NO:4136
LRCQLGDRLNVEVDTAPTVDLNRVL,   SEQ ID NO:4137
LRSQLGDRLNVEVDTAPTVDLNRVL,   SEQ ID NO:4138
LRCPLGDRLNVEVDTAPTVDLNRVL,   SEQ ID NO:4139
LRSPLGDRLNVEVDTAPTVDLNRV,    SEQ ID NO:4140
RCQLGDRLNVEVDAAPTVDLNQVLN,   SEQ ID NO:4141
RSQLGDRLNVEVDAAPTVDLNQVLN,   SEQ ID NO:4142
RCPLGDRLNVEVDAAPTVDLNQVLN,   SEQ ID NO:4143
RSPLGDRLNVEVDAAPTVDLNQVLN,   SEQ ID NO:4144
RCQLGDRLNVEVDTAPTVDLNQVLN,   SEQ ID NO:4145
RSQLGDRLNVEVDTAPTVDLNQVLN,   SEQ ID NO:4146
RCPLGDRLNVEVDTAPTVDLNQVLN,   SEQ ID NO:4147
RSPLGDRLNVEVDTAPTVDLNQVLN,   SEQ ID NO:4148
RCQLGDRLNVEVDAAPTVDLNRVLN,   SEQ ID NO:4149
RSQLGDRLNVEVDAAPTVDLNRVLN,   SEQ ID NO:4150
RCPLGDRLNVEVDAAPTVDLNRVLN,   SEQ ID NO:4151
RSPLGDRLNVEVDAAPTVDLNRVLN,   SEQ ID NO:4152
RCQLGDRLNVEVDTAPTVDLNRVLN,   SEQ ID NO:4153
RSQLGDRLNVEVDTAPTVDLNRVLN,   SEQ ID NO:4154
RCPLGDRLNVEVDTAPTVDLNRVLN,   SEQ ID NO:4155
RSPLGDRLNVEVDTAPTVDLNRVLN,   SEQ ID NO:4156
CQLGDRLNVEVDAAPTVDLNQVLNE,   SEQ ID NO:4157
SQLGDRLNVEVDAAPTVDLNQVLNE,   SEQ ID NO:4158
CPLGDRLNVEVDAAPTVDLNQVLNE,   SEQ ID NO:4159
SPLGDRLNVEVDAAPTVDLNQVLNE,   SEQ ID NO:4160
CQLGDRLNVEVDTAPTVDLNQVLNE,   SEQ ID NO:4161
SQLGDRLNVEVDTAPTVDLNQVLNE,   SEQ ID NO:4162
CPLGDRLNVEVDTAPTVDLNQVLNE,   SEQ ID NO:4163
SPLGDRLNVEVDTAPTVDLNQVLNE,   SEQ ID NO:4164
CQLGDRLNVEVDAAPTVDLNRVLNE,   SEQ ID NO:4165
SQLGDRLNVEVDAAPTVDLNRVLNE,   SEQ ID NO:4166
CPLGDRLNVEVDAAPTVDLNRVLNE,   SEQ ID NO:4167
SPLGDRLNVEVDAAPTVDLNRVLNE,   SEQ ID NO:4168
CQLGDRLNVEVDTAPTVDLNRVLNE,   SEQ ID NO:4169
SQLGDRLNVEVDTAPTVDLNRVLNE,   SEQ ID NO:4170
CPLGDRLNVEVDTAPTVDLNRVLNE,   SEQ ID NO:4171
SPLGDRLNVEVDTAPTVDLNRVLNE,   SEQ ID NO:4172
QLGDRLNVEVDAAPTVDLNQVLNET,   SEQ ID NO:4173
PLGDRLNVEVDAAPTVDLNQVLNET,   SEQ ID NO:4174
QLGDRLNVEVDTAPTVDLNQVLNET,   SEQ ID NO:4175
PLGDRLNVEVDTAPTVDLNQVLNET,   SEQ ID NO:4176
QLGDRLNVEVDAAPTVDLNRVLNET,   SEQ ID NO:4177
PLGDRLNVEVDAAPTVDLNRVLNET,   SEQ ID NO:4178
QLGDRLNVEVDTAPTVDLNRVLNET,   SEQ ID NO:4179
PLGDRLNVEVDTAPTVDLNRVLNET,   SEQ ID NO:4180
LGDRLNVEVDAAPTVDLNQVLNETR,   SEQ ID NO:4181;
```

-continued

```
LGDRLNVEVDAAPTVDLNRVLNETR,     SEQ ID NO:4182;
LGDRLNVEVDTAPTVDLNQVLNETR,     SEQ ID NO:4183;
LGDRLNVEVDTAPTVDLNRVLNETR,     SEQ ID NO:4184;
GDRLNVEVDAAPTVDLNQVLNETRS,     SEQ ID NO:4185
GDRLNVEVDTAPTVDLNQVLNETRS,     SEQ ID NO:4186
GDRLNVEVDAAPTVDLNRVLNETRS,     SEQ ID NO:4187
GDRLNVEVDTAPTVDLNRVLNETRS,     SEQ ID NO:4188
GDRLNVEVDAAPTVDLNQVLNETRN,     SEQ ID NO:4189
GDRLNVEVDTAPTVDLNQVLNETRN,     SEQ ID NO:4190
GDRLNVEVDAAPTVDLNRVLNETRN,     SEQ ID NO:4191
GDRLNVEVDTAPTVDLNRVLNETRN,     SEQ ID NO:4192
DRLNVEVDAAPTVDLNQVLNETRSQ,     SEQ ID NO:4193
DRLNVEVDTAPTVDLNQVLNETRSQ,     SEQ ID NO:4194
DRLNVEVDAAPTVDLNRVLNETRSQ,     SEQ ID NO:4195
DRLNVEVDTAPTVDLNRVLNETRSQ,     SEQ ID NO:4196
DRLNVEVDAAPTVDLNQVLNETRNQ,     SEQ ID NO:4197
DRLNVEVDTAPTVDLNQVLNETRNQ,     SEQ ID NO:4198
DRLNVEVDAAPTVDLNRVLNETRNQ,     SEQ ID NO:4199
DRLNVEVDTAPTVDLNRVLNETRNQ,     SEQ ID NO:4200
RLNVEVDAAPTVDLNQVLNETRSQY,     SEQ ID NO:4201
RLNVEVDTAPTVDLNQVLNETRSQY,     SEQ ID NO:4202
RLNVEVDAAPTVDLNRVLNETRSQY,     SEQ ID NO:4203
RLNVEVDTAPTVDLNRVLNETRSQY,     SEQ ID NO:4204
RLNVEVDAAPTVDLNQVLNETRNQY,     SEQ ID NO:4205
RLNVEVDTAPTVDLNQVLNETRNQY,     SEQ ID NO:4206
RLNVEVDAAPTVDLNRVLNETRNQY,     SEQ ID NO:4207
RLNVEVDTAPTVDLNRVLNETRNQY,     SEQ ID NO:4208
LNVEVDAAPTVDLNQVLNETRSQYE,     SEQ ID NO:4209
LNVEVDTAPTVDLNQVLNETRSQYE,     SEQ ID NO:4210
LNVEVDAAPTVDLNRVLNETRSQYE,     SEQ ID NO:4211
LNVEVDTAPTVDLNRVLNETRSQYE,     SEQ ID NO:4212
LNVEVDAAPTVDLNQVLNETRNQYE,     SEQ ID NO:4213
LNVEVDTAPTVDLNQVLNETRNQYE,     SEQ ID NO:4214
LNVEVDAAPTVDLNRVLNETRNQYE,     SEQ ID NO:4215
LNVEVDTAPTVDLNRVLNETRNQYE,     SEQ ID NO:4216
NVEVDAAPTVDLNQVLNETRSQYEA,     SEQ ID NO:4217
NVEVDTAPTVDLNQVLNETRSQYEA,     SEQ ID NO:4218
NVEVDAAPTVDLNRVLNETRSQYEA,     SEQ ID NO:4219
NVEVDTAPTVDLNRVLNETRSQYEA,     SEQ ID NO:4220
NVEVDAAPTVDLNQVLNETRNQYEA,     SEQ ID NO:4221
NVEVDTAPTVDLNQVLNETRNQYEA,     SEQ ID NO:4222
NVEVDAAPTVDLNRVLNETRNQYEA,     SEQ ID NO:4223
NVEVDTAPTVDLNRVLNETRNQYEA,     SEQ ID NO:4224
VEVDAAPTVDLNQVLNETRSQYEAL,     SEQ ID NO:4225
VEVDTAPTVDLNQVLNETRSQYEAL,     SEQ ID NO:4226
VEVDAAPTVDLNRVLNETRSQYEAL,     SEQ ID NO:4227
VEVDTAPTVDLNRVLNETRSQYEAL,     SEQ ID NO:4228
VEVDAAPTVDLNQVLNETRNQYEAL,     SEQ ID NO:4229
VEVDTAPTVDLNQVLNETRNQYEAL,     SEQ ID NO:4230
VEVDAAPTVDLNRVLNETRNQYEAL,     SEQ ID NO:4231
VEVDTAPTVDLNRVLNETRNQYEAL,     SEQ ID NO:4232
EVNTLRCQLGDRLNVEVDAAPTVDLN,    SEQ ID NO:4233
EVNTLRSQLGDRLNVEVDAAPTVDLN,    SEQ ID NO:4234
EVNTLRCPLGDRLNVEVDAAPTVDLN,    SEQ ID NO:4235
EVNTLRSPLGDRLNVEVDAAPTVDLN,    SEQ ID NO:4236
EVNTLRCQLGDRLNVEVDTAPTVDLN,    SEQ ID NO:4237
EVNTLRSQLGDRLNVEVDTAPTVDLN,    SEQ ID NO:4238
EVNTLRCPLGDRLNVEVDTAPTVDLN,    SEQ ID NO:4239
EVNTLRSPLGDRLNVEVDTAPTVDLN,    SEQ ID NO:4240
VNTLRCQLGDRLNVEVDAAPTVDLNQ,    SEQ ID NO:4241
VNTLRSQLGDRLNVEVDAAPTVDLNQ,    SEQ ID NO:4242
VNTLRCPLGDRLNVEVDAAPTVDLNQ,    SEQ ID NO:4243
VNTLRSPLGDRLNVEVDAAPTVDLNQ,    SEQ ID NO:4244
VNTLRCQLGDRLNVEVDTAPTVDLNQ,    SEQ ID NO:4245
VNTLRSQLGDRLNVEVDTAPTVDLNQ,    SEQ ID NO:4246
VNTLRCPLGDRLNVEVDTAPTVDLNQ,    SEQ ID NO:4247
VNTLRSPLGDRLNVEVDTAPTVDLNQ,    SEQ ID NO:4248
VNTLRCQLGDRLNVEVDAAPTVDLNR,    SEQ ID NO:4249
VNTLRSQLGDRLNVEVDAAPTVDLNR,    SEQ ID NO:4250
VNTLRCPLGDRLNVEVDAAPTVDLNR,    SEQ ID NO:4251
VNTLRSPLGDRLNVEVDAAPTVDLNR,    SEQ ID NO:4252
VNTLRCQLGDRLNVEVDTAPTVDLNR,    SEQ ID NO:4253
VNTLRSQLGDRLNVEVDTAPTVDLNR,    SEQ ID NO:4254
VNTLRCPLGDRLNVEVDTAPTVDLNR,    SEQ ID NO:4255
VNTLRSPLGDRLNVEVDTAPTVDLNR,    SEQ ID NO:4256
NTLRCQLGDRLNVEVDAAPTVDLNQV,    SEQ ID NO:4257
NTLRSQLGDRLNVEVDAAPTVDLNQV,    SEQ ID NO:4258
NTLRCPLGDRLNVEVDAAPTVDLNQV,    SEQ ID NO:4259
NTLRSPLGDRLNVEVDAAPTVDLNQV,    SEQ ID NO:4260
NTLRCQLGDRLNVEVDTAPTVDLNQV,    SEQ ID NO:4261
```

```
NTLRSQLGDRLNVEVDTAPTVDLNQV,   SEQ ID NO:4262
NTLRCPLGDRLNVEVDTAPTVDLNQV,   SEQ ID NO:4263
NTLRSPLGDRLNVEVDTAPTVDLNQV,   SEQ ID NO:4264
NTLRCQLGDRLNVEVDAAPTVDLNRV,   SEQ ID NO:4265
NTLRSQLGDRLNVEVDAAPTVDLNRV,   SEQ ID NO:4266
NTLRCPLGDRLNVEVDAAPTVDLNRV,   SEQ ID NO:4267
NTLRSPLGDRLNVEVDAAPTVDLNRV,   SEQ ID NO:4268
NTLRCQLGDRLNVEVDTAPTVDLNRV,   SEQ ID NO:4269
NTLRSQLGDRLNVEVDTAPTVDLNRV,   SEQ ID NO:4270
NTLRCPLGDRLNVEVDTAPTVDLNRV,   SEQ ID NO:4271
NTLRSPLGDRLNVEVDTAPTVDLNRV,   SEQ ID NO:4272
TLRCQLGDRLNVEVDAAPTVDLNQVL,   SEQ ID NO:4273
TLRSQLGDRLNVEVDAAPTVDLNQVL,   SEQ ID NO:4274
TLRCPLGDRLNVEVDAAPTVDLNQVL,   SEQ ID NO:4275
TLRSPLGDRLNVEVDAAPTVDLNQVL,   SEQ ID NO:4276
TLRCQLGDRLNVEVDTAPTVDLNQVL,   SEQ ID NO:4277
TLRSQLGDRLNVEVDTAPTVDLNQVL,   SEQ ID NO:4278
TLRCPLGDRLNVEVDTAPTVDLNQVL,   SEQ ID NO:4279
TLRSPLGDRLNVEVDTAPTVDLNQVL,   SEQ ID NO:4280
TLRCQLGDRLNVEVDAAPTVDLNRVL,   SEQ ID NO:4281
TLRSQLGDRLNVEVDAAPTVDLNRVL,   SEQ ID NO:4282
TLRCPLGDRLNVEVDAAPTVDLNRVL,   SEQ ID NO:4283
TLRSPLGDRLNVEVDAAPTVDLNRVL,   SEQ ID NO:4284
TLRCQLGDRLNVEVDTAPTVDLNRVL,   SEQ ID NO:4285
TLRSQLGDRLNVEVDTAPTVDLNRVL,   SEQ ID NO:4286
TLRCPLGDRLNVEVDTAPTVDLNRVL,   SEQ ID NO:4287
TLRSPLGDRLNVEVDTAPTVDLNRVL,   SEQ ID NO:4288
LRCQLGDRLNVEVDAAPTVDLNQVLN,   SEQ ID NO:4289
LRSQLGDRLNVEVDAAPTVDLNQVLN,   SEQ ID NO:4290
LRCPLGDRLNVEVDAAPTVDLNQVLN,   SEQ ID NO:4291
LRSPLGDRLNVEVDAAPTVDLNQVLN,   SEQ ID NO:4292
LRCQLGDRLNVEVDTAPTVDLNQVLN,   SEQ ID NO:4293
LRSQLGDRLNVEVDTAPTVDLNQVLN,   SEQ ID NO:4294
LRCPLGDRLNVEVDTAPTVDLNQVLN,   SEQ ID NO:4295
LRSPLGDRLNVEVDTAPTVDLNQVLN,   SEQ ID NO:4296
LRCQLGDRLNVEVDAAPTVDLNRVLN,   SEQ ID NO:4297
LRSQLGDRLNVEVDAAPTVDLNRVLN,   SEQ ID NO:4298
LRCPLGDRLNVEVDAAPTVDLNRVLN,   SEQ ID NO:4299
LRSPLGDRLNVEVDAAPTVDLNRVLN,   SEQ ID NO:4300
LRCQLGDRLNVEVDTAPTVDLNRVLN,   SEQ ID NO:4301
LRSQLGDRLNVEVDTAPTVDLNRVLN,   SEQ ID NO:4302
LRCPLGDRLNVEVDTAPTVDLNRVLN,   SEQ ID NO:4303
LRSPLGDRLNVEVDTAPTVDLNRVLN,   SEQ ID NO:4304
RCQLGDRLNVEVDAAPTVDLNQVLNE,   SEQ ID NO:4305
RSQLGDRLNVEVDAAPTVDLNQVLNE,   SEQ ID NO:4306
RCPLGDRLNVEVDAAPTVDLNQVLNE,   SEQ ID NO:4307
RSPLGDRLNVEVDAAPTVDLNQVLNE,   SEQ ID NO:4308
RCQLGDRLNVEVDTAPTVDLNQVLNE,   SEQ ID NO:4309
RSQLGDRLNVEVDTAPTVDLNQVLNE,   SEQ ID NO:4310
RCPLGDRLNVEVDTAPTVDLNQVLNE,   SEQ ID NO:4311
RSPLGDRLNVEVDTAPTVDLNQVLNE,   SEQ ID NO:4312
RCQLGDRLNVEVDAAPTVDLNRVLNE,   SEQ ID NO:4313
RSQLGDRLNVEVDAAPTVDLNRVLNE,   SEQ ID NO:4314
RCPLGDRLNVEVDAAPTVDLNRVLNE,   SEQ ID NO:4315
RSPLGDRLNVEVDAAPTVDLNRVLNE,   SEQ ID NO:4316
RCQLGDRLNVEVDTAPTVDLNRVLNE,   SEQ ID NO:4317
RSQLGDRLNVEVDTAPTVDLNRVLNE,   SEQ ID NO:4318
RCPLGDRLNVEVDTAPTVDLNRVLNE,   SEQ ID NO:4319
RSPLGDRLNVEVDTAPTVDLNRVLNE,   SEQ ID NO:4320
CQLGDRLNVEVDAAPTVDLNQVLNET,   SEQ ID NO:4321
SQLGDRLNVEVDAAPTVDLNQVLNET,   SEQ ID NO:4322
CPLGDRLNVEVDAAPTVDLNQVLNET,   SEQ ID NO:4323
SPLGDRLNVEVDAAPTVDLNQVLNET,   SEQ ID NO:4324
CQLGDRLNVEVDTAPTVDLNQVLNET,   SEQ ID NO:4325
SQLGDRLNVEVDTAPTVDLNQVLNET,   SEQ ID NO:4326
CPLGDRLNVEVDTAPTVDLNQVLNET,   SEQ ID NO:4327
SPLGDRLNVEVDTAPTVDLNQVLNET,   SEQ ID NO:4328
CQLGDRLNVEVDAAPTVDLNRVLNET,   SEQ ID NO:4329
SQLGDRLNVEVDAAPTVDLNRVLNET,   SEQ ID NO:4330
CPLGDRLNVEVDAAPTVDLNRVLNET,   SEQ ID NO:4331
SPLGDRLNVEVDAAPTVDLNRVLNET,   SEQ ID NO:4332
CQLGDRLNVEVDTAPTVDLNRVLNET,   SEQ ID NO:4333
SQLGDRLNVEVDTAPTVDLNRVLNET,   SEQ ID NO:4334
CPLGDRLNVEVDTAPTVDLNRVLNET,   SEQ ID NO:4335
SPLGDRLNVEVDTAPTVDLNRVLNET,   SEQ ID NO:4336
QLGDRLNVEVDAAPTVDLNQVLNETR,   SEQ ID NO:4337
PLGDRLNVEVDAAPTVDLNQVLNETR,   SEQ ID NO:4338
QLGDRLNVEVDTAPTVDLNQVLNETR,   SEQ ID NO:4339
PLGDRLNVEVDTAPTVDLNQVLNETR,   SEQ ID NO:4340
QLGDRLNVEVDAAPTVDLNRVLNETR,   SEQ ID NO:4341
```

-continued

```
PLGDRLNVEVDAAPTVDLNRVLNETR,    SEQ ID NO:4342
QLGDRLNVEVDTAPTVDLNRVLNETR,    SEQ ID NO:4343
PLGDRLNVEVDTAPTVDLNRVLNETR,    SEQ ID NO:4344
LGDRLNVEVDAAPTVDLNQVLNETRS,    SEQ ID NO:4345
LGDRLNVEVDTAPTVDLNQVLNETRS,    SEQ ID NO:4346
LGDRLNVEVDAAPTVDLNRVLNETRS,    SEQ ID NO:4347
LGDRLNVEVDTAPTVDLNRVLNETRS,    SEQ ID NO:4348
LGDRLNVEVDAAPTVDLNQVLNETRN,    SEQ ID NO:4349
LGDRLNVEVDTAPTVDLNQVLNETRN,    SEQ ID NO:4350
LGDRLNVEVDAAPTVDLNRVLNETRN,    SEQ ID NO:4351
LGDRLNVEVDTAPTVDLNRVLNETRN,    SEQ ID NO:4352
GDRLNVEVDAAPTVDLNQVLNETRSQ,    SEQ ID NO:4353
GDRLNVEVDTAPTVDLNQVLNETRSQ,    SEQ ID NO:4354
GDRLNVEVDAAPTVDLNRVLNETRSQ,    SEQ ID NO:4355
GDRLNVEVDTAPTVDLNRVLNETRSQ,    SEQ ID NO:4356
GDRLNVEVDAAPTVDLNQVLNETRNQ,    SEQ ID NO:4357
GDRLNVEVDTAPTVDLNQVLNETRNQ,    SEQ ID NO:4358
GDRLNVEVDAAPTVDLNRVLNETRNQ,    SEQ ID NO:4359
GDRLNVEVDTAPTVDLNRVLNETRNQ,    SEQ ID NO:4360
DRLNVEVDAAPTVDLNQVLNETRSQY,    SEQ ID NO:4361
DRLNVEVDTAPTVDLNQVLNETRSQY,    SEQ ID NO:4362
DRLNVEVDANPTVDLNRVLNETRSQY,    SEQ ID NO:4363
DRLNVEVDTAPTVDLNRVLNETRSQY,    SEQ ID NO:4364
DRLNVEVDAAPTVDLNQVLNETRNQY,    SEQ ID NO:4365
DRLNVEVDTAPTVDLNQVLNETRNQY,    SEQ ID NO:4366
DRLNVEVDAAPTVDLNRVLNETRNQY,    SEQ ID NO:4367
DRLNVEVDTAPTVDLNRVLNETRNQY,    SEQ ID NO:4368
RLNVEVDAAPTVDLNQVLNETRSQYE,    SEQ ID NO:4369
RLNVEVDTAPTVDLNQVLNETRSQYE,    SEQ ID NO:4370
RLNVEVDAAPTVDLNRVLNETRSQYE,    SEQ ID NO:4371
RLNVEVDTAPTVDLNRVLNETRSQYE,    SEQ ID NO:4372
RLNVEVDAAPTVDLNQVLNETRNQYE,    SEQ ID NO:4373
RLNVEVDTAPTVDLNQVLNETRNQYE,    SEQ ID NO:4374
RLNVEVDAAPTVDLNRVLNETRNQYE,    SEQ ID NO:4375
RLNVEVDTAPTVDLNRVLNETRNQYE,    SEQ ID NO:4376
LNVEVDAAPTVDLNQVLNETRSQYEA,    SEQ ID NO:4377
LNVEVDTAPTVDLNQVLNETRSQYEA,    SEQ ID NO:4378
LNVEVDAAPTVDLNRVLNETRSQYEA,    SEQ ID NO:4379
LNVEVDTAPTVDLNRVLNETRSQYEA,    SEQ ID NO:4380
LNVEVDAAPTVDLNQVLNETRNQYEA,    SEQ ID NO:4381
LNVEVDTAPTVDLNQVLNETRNQYEA,    SEQ ID NO:4382
LNVEVDAAPTVDLNRVLNETRNQYEA,    SEQ ID NO:4383
LNVEVDTAPTVDLNRVLNETRNQYEA,    SEQ ID NO:4384
NVEVDAAPTVDLNQVLNETRSQYEAL,    SEQ ID NO:4385
NVEVDTAPTVDLNQVLNETRSQYEAL,    SEQ ID NO:4386
NVEVDAAPTVDLNRVLNETRSQYEAL,    SEQ ID NO:4387
NVEVDTAPTVDLNRVLNETRSQYEAL,    SEQ ID NO:4388
NVEVDAAPTVDLNQVLNETRNQYEAL,    SEQ ID NO:4389
NVEVDTAPTVDLNQVLNETRNQYEAL,    SEQ ID NO:4390
NVEVDAAPTVDLNRVLNETRNQYEAL,    SEQ ID NO:4391
NVEVDTAPTVDLNRVLNETRNQYEAL,    SEQ ID NO:4392
EVNTLRCQLGDRLNVEVDAAPTVDLNQ,   SEQ ID NO:4393
EVNTLRSQLGDRLNVEVDAAPTVDLNQ,   SEQ ID NO:4394
EVNTLRCPLGDRLNVEVDAAPTVDLNQ,   SEQ ID NO:4395
EVNTLRSPLGDRLNVEVDAAPTVDLNQ,   SEQ ID NO:4396
EVNTLRCQLGDRLNVEVDTAPTVDLNQ,   SEQ ID NO:4397
EVNTLRSQLGDRLNVEVDTAPTVDLNQ,   SEQ ID NO:4398
EVNTLRCPLGDRLNVEVDTAPTVDLNQ,   SEQ ID NO:4399
EVNTLRSPLGDRLNVEVDTAPTVDLNQ,   SEQ ID NO:4400
EVNTLRCQLGDRLNVEVDAAPTVDLNR,   SEQ ID NO:4401
EVNTLRSQLGDRLNVEVDAAPTVDLNR,   SEQ ID NO:4402
EVNTLRCPLGDRLNVEVDAAPTVDLNR,   SEQ ID NO:4403
EVNTLRSPLGDRLNVEVDAAPTVDLNR,   SEQ ID NO:4404
EVNTLRCQLGDRLNVEVDTAPTVDLNR,   SEQ ID NO:4405
EVNTLRSQLGDRLNVEVDTAPTVDLNR,   SEQ ID NO:4406
EVNTLRCPLGDRLNVEVDTAPTVDLNR,   SEQ ID NO:4407
EVNTLRSPLGDRLNVEVDTAPTVDLNR,   SEQ ID NO:4408
VNTLRCQLGDRLNVEVDAAPTVDLNQV,   SEQ ID NO:4409
VNTLRSQLGDRLNVEVDAAPTVDLNQV,   SEQ ID NO:4410
VNTLRCPLGDRLNVEVDAAPTVDLNQV,   SEQ ID NO:4411
VNTLRSPLGDRLNVEVDAAPTVDLNQV,   SEQ ID NO:4412
VNTLRCQLGDRLNVEVDTAPTVDLNQV,   SEQ ID NO:4413
VNTLRSQLGDRLNVEVDTAPTVDLNQV,   SEQ ID NO:4414
VNTLRCPLGDRLNVEVDTAPTVDLNQV,   SEQ ID NO:4415
VNTLRSPLGDRLNVEVDTAPTVDLNQV,   SEQ ID NO:4416
VNTLRCQLGDRLNVEVDAAPTVDLNRV,   SEQ ID NO:4417
VNTLRSQLGDRLNVEVDAAPTVDLNRV,   SEQ ID NO:4418
VNTLRCPLGDRLNVEVDAAPTVDLNRV,   SEQ ID NO:4419
VNTLRSPLGDRLNVEVDAAPTVDLNRV,   SEQ ID NO:4420
VNTLRCQLGDRLNVEVDTAPTVDLNRV,   SEQ ID NO:4421
```

```
VNTLRSQLGDRLNVEVDTAPTVDLNRV,   SEQ ID NO:4422
VNTLRCPLGDRLNVEVDTAPTVDLNRV,   SEQ ID NO:4423
VNTLRSPLGDRLNVEVDTAPTVDLNRV,   SEQ ID NO:4424
NTLRCQLGDRLNVEVDAAPTVDLNQVL,   SEQ ID NO:4425
NTLRSQLGDRLNVEVDAAPTVDLNQVL,   SEQ ID NO:4426
NTLRCPLGDRLNVEVDAAPTVDLNQVL,   SEQ ID NO:4427
NTLRSPLGDRLNVEVDAAPTVDLNQVL,   SEQ ID NO:4428
NTLRCQLGDRLNVEVDTAPTVDLNQVL,   SEQ ID NO:4429
NTLRSQLGDRLNVEVDTAPTVDLNQVL,   SEQ ID NO:4430
NTLRCPLGDRLNVEVDTAPTVDLNQVL,   SEQ ID NO:4431
NTLRSPLGDRLNVEVDTAPTVDLNQVL,   SEQ ID NO:4432
NTLRCQLGDRLNVEVDAAPTVDLNRVL,   SEQ ID NO:4433
NTLRSQLGDRLNVEVDAAPTVDLNRVL,   SEQ ID NO:4434
NTLRCPLGDRLNVEVDAAPTVDLNRVL,   SEQ ID NO:4435
NTLRSPLGDRLNVEVDAAPTVDLNRVL,   SEQ ID NO:4436
NTLRCQLGDRLNVEVDTAPTVDLNRVL,   SEQ ID NO:4437
NTLRSQLGDRLNVEVDTAPTVDLNRVL,   SEQ ID NO:4438
NTLRCPLGDRLNVEVDTAPTVDLNRVL,   SEQ ID NO:4439
NTLRSPLGDRLNVEVDTAPTVDLNRVL,   SEQ ID NO:4440
TLRCQLGDRLNVEVDAAPTVDLNQVLN,   SEQ ID NO:4441
TLRSQLGDRLNVEVDAAPTVDLNQVLN,   SEQ ID NO:4442
TLRCPLGDRLNVEVDAAPTVDLNQVLN,   SEQ ID NO:4443
TLRSPLGDRLNVEVDAAPTVDLNQVLN,   SEQ ID NO:4444
TLRCQLGDRLNVEVDTAPTVDLNQVLN,   SEQ ID NO:4445
TLRSQLGDRLNVEVDTAPTVDLNQVLN,   SEQ ID NO:4446
TLRCPLGDRLNVEVDTAPTVDLNQVLN,   SEQ ID NO:4447
TLRSPLGDRLNVEVDTAPTVDLNQVLN,   SEQ ID NO:4448
TLRCQLGDRLNVEVDAAPTVDLNRVLN,   SEQ ID NO:4449
TLRSQLGDRLNVEVDAAPTVDLNRVLN,   SEQ ID NO:4450
TLRCPLGDRLNVEVDAAPTVDLNRVLN,   SEQ ID NO:4451
TLRSPLGDRLNVEVDAAPTVDLNRVLN,   SEQ ID NO:4452
TLRCQLGDRLNVEVDTAPTVDLNRVLN,   SEQ ID NO:4453
TLRSQLGDRLNVEVDTAPTVDLNRVLN,   SEQ ID NO:4454
TLRCPLGDRLNVEVDTAPTVDLNRVLN,   SEQ ID NO:4455
TLRSPLGDRLNVEVDTAPTVDLNRVLN,   SEQ ID NO:4456
LRCQLGDRLNVEVDAAPTVDLNQVLNE,   SEQ ID NO:4457
LRSQLGDRLNVEVDAAPTVDLNQVLNE,   SEQ ID NO:4458
LRCPLGDRLNVEVDAAPTVDLNQVLNE,   SEQ ID NO:4459
LRSPLGDRLNVEVDAAPTVDLNQVLNE,   SEQ ID NO:4460
LRCQLGDRLNVEVDTAPTVDLNQVLNE,   SEQ ID NO:4461
LRSQLGDRLNVEVDTAPTVDLNQVLNE,   SEQ ID NO:4462
LRCPLGDRLNVEVDTAPTVDLNQVLNE,   SEQ ID NO:4463
LRSPLGDRLNVEVDTAPTVDLNQVLNE,   SEQ ID NO:4464
LRCQLGDRLNVEVDAAPTVDLNRVLNE,   SEQ ID NO:4465
LRSQLGDRLNVEVDAAPTVDLNRVLNE,   SEQ ID NO:4466
LRCPLGDRLNVEVDAAPTVDLNRVLNE,   SEQ ID NO:4467
LRSPLGDRLNVEVDAAPTVDLNRVLNE,   SEQ ID NO:4468
LRCQLGDRLNVEVDTAPTVDLNRVLNE,   SEQ ID NO:4469
LRSQLGDRLNVEVDTAPTVDLNRVLNE,   SEQ ID NO:4470
LRCPLGDRLNVEVDTAPTVDLNRVLNE,   SEQ ID NO:4471
LRSPLGDRLNVEVDTAPTVDLNRVLNE,   SEQ ID NO:4472
RCQLGDRLNVEVDAAPTVDLNQVLNET,   SEQ ID NO:4473
RSQLGDRLNVEVDAAPTVDLNQVLNET,   SEQ ID NO:4474
RCPLGDRLNVEVDAAPTVDLNQVLNET,   SEQ ID NO:4475
RSPLGDRLNVEVDAAPTVDLNQVLNET,   SEQ ID NO:4476
RCQLGDRLNVEVDTAPTVDLNQVLNET,   SEQ ID NO:4477
RSQLGDRLNVEVDTAPTVDLNQVLNET,   SEQ ID NO:4478
RCPLGDRLNVEVDTAPTVDLNQVLNET,   SEQ ID NO:4479
RSPLGDRLNVEVDTAPTVDLNQVLNET,   SEQ ID NO:4480
RCQLGDRLNVEVDAAPTVDLNRVLNET,   SEQ ID NO:4481
RSQLGDRLNVEVDAAPTVDLNRVLNET,   SEQ ID NO:4482
RCPLGDRLNVEVDAAPTVDLNRVLNET,   SEQ ID NO:4483
RSPLGDRLNVEVDAAPTVDLNRVLNET,   SEQ ID NO:4484
RCQLGDRLNVEVDTAPTVDLNRVLNET,   SEQ ID NO:4485
RSQLGDRLNVEVDTAPTVDLNRVLNET,   SEQ ID NO:4486
RCPLGDRLNVEVDTAPTVDLNRVLNET,   SEQ ID NO:4487
RSPLGDRLNVEVDTAPTVDLNRVLNET,   SEQ ID NO:4488
CQLGDRLNVEVDAAPTVDLNQVLNETR,   SEQ ID NO:4489
SQLGDRLNVEVDAAPTVDLNQVLNETR,   SEQ ID NO:4490
CPLGDRLNVEVDAAPTVDLNQVLNETR,   SEQ ID NO:4491
SPLGDRLNVEVDAAPTVDLNQVLNETR,   SEQ ID NO:4492
CQLGDRLNVEVDTAPTVDLNQVLNETR,   SEQ ID NO:4493
SQLGDRLNVEVDTAPTVDLNQVLNETR,   SEQ ID NO:4494
CPLGDRLNVEVDTAPTVDLNQVLNETR,   SEQ ID NO:4495
SPLGDRLNVEVDTAPTVDLNQVLNETR,   SEQ ID NO:4496
CQLGDRLNVEVDAAPTVDLNRVLNETR,   SEQ ID NO:4497
SQLGDRLNVEVDAAPTVDLNRVLNETR,   SEQ ID NO:4498
CPLGDRLNVEVDAAPTVDLNRVLNETR,   SEQ ID NO:4499
SPLGDRLNVEVDAAPTVDLNRVLNETR,   SEQ ID NO:4500
CQLGDRLNVEVDTAPTVDLNRVLNETR,   SEQ ID NO:4501
```

-continued

```
SQLGDRLNVEVDTAPTVDLNRVLNETR,    SEQ ID NO:4502
CPLGDRLNVEVDTAPTVDLNRVLNETR,    SEQ ID NO:4503
SPLGDRLNVEVDTAPTVDLNRVLNETR,    SEQ ID NO:4504
QLGDRLNVEVDAAPTVDLNQVLNETRS,    SEQ ID NO:4505
PLGDRLNVEVDAAPTVDLNQVLNETRS,    SEQ ID NO:4506
QLGDRLNVEVDTAPTVDLNQVLNETRS,    SEQ ID NO:4507
PLGDRLNVEVDTAPTVDLNQVLNETRS,    SEQ ID NO:4508
QLGDRLNVEVDAAPTVDLNRVLNETRS,    SEQ ID NO:4509
PLGDRLNVEVDAAPTVDLNRVLNETRS,    SEQ ID NO:4510
QLGDRLNVEVDTAPTVDLNRVLNETRS,    SEQ ID NO:4511
PLGDRLNVEVDTAPTVDLNRVLNETRS,    SEQ ID NO:4512
QLGDRLNVEVDAAPTVDLNQVLNETRN,    SEQ ID NO:4513
PLGDRLNVEVDAAPTVDLNQVLNETRN,    SEQ ID NO:4514
QLGDRLNVEVDTAPTVDLNQVLNETRN,    SEQ ID NO:4515
PLGDRLNVEVDTAPTVDLNQVLNETRN,    SEQ ID NO:4516
QLGDRLNVEVDAAPTVDLNRVLNETRN,    SEQ ID NO:4517
PLGDRLNVEVDAAPTVDLNRVLNETRN,    SEQ ID NO:4518
QLGDRLNVEVDTAPTVDLNRVLNETRN,    SEQ ID NO:4519
PLGDRLNVEVDTAPTVDLNRVLNETRN,    SEQ ID NO:4520
LGDRLNVEVDAAPTVDLNQVLNETRSQ,    SEQ ID NO:4521
LGDRLNVEVDTAPTVDLNQVLNETRSQ,    SEQ ID NO:4522
LGDRLNVEVDAAPTVDLNRVLNETRSQ,    SEQ ID NO:4523
LGDRLNVEVDTAPTVDLNRVLNETRSQ,    SEQ ID NO :4524
LGDRLNVEVDAAPTVDLNQVLNETRNQ,    SEQ ID NO:4525
LGDRLNVEVDTAPTVDLNQVLNETRNQ,    SEQ ID NO:4526
LGDRLNVEVDAAPTVDLNRVLNETRNQ,    SEQ ID NO:4527
LGDRLNVEVDTAPTVDLNRVLNETRNQ,    SEQ ID NO:4528
GDRLNVEVDAAPTVDLNQVLNETRSQY,    SEQ ID NO:4529
GDRLNVEVDTAPTVDLNQVLNETRSQY,    SEQ ID NO:4530
GDRLNVEVDAAPTVDLNRVLNETRSQY,    SEQ ID NO:4531
GDRLNVEVDTAPTVDLNRVLNETRSQY,    SEQ ID NO:4532
GDRLNVEVDAAPTVDLNQVLNETRNQY,    SEQ ID NO:4533
GDRLNVEVDTAPTVDLNQVLNETRNQY,    SEQ ID NO:4534
GDRLNVEVDAAPTVDLNRVLNETRNQY,    SEQ ID NO:4535
GDRLNVEVDTAPTVDLNRVLNETRNQY,    SEQ ID NO:4536
DRLNVEVDAAPTVDLNQVLNETRSQYE,    SEQ ID NO:4537
DRLNVEVDTAPTVDLNQVLNETRSQYE,    SEQ ID NO:4538
DRLNVEVDAAPTVDLNRVLNETRSQYE,    SEQ ID NO:4539
DRLNVEVDTAPTVDLNRVLNETRSQYE,    SEQ ID NO:4540
DRLNVEVDAAPTVDLNQVLNETRNQYE,    SEQ ID NO:4541
DRLNVEVDTAPTVDLNQVLNETRNQYE,    SEQ ID NO:4542
DRLNVEVDAAPTVDLNRVLNETRNQYE,    SEQ ID NO:4543
DRLNVEVDTAPTVDLNRVLNETRNQYE,    SEQ ID NO:4544
RLNVEVDAAPTVDLNQVLNETRSQYEA,    SEQ ID NO:4545
RLNVEVDTAPTVDLNQVLNETRSQYEA,    SEQ ID NO:4546
RLNVEVDAAPTVDLNRVLNETRSQYEA,    SEQ ID NO:4547
RLNVEVDTAPTVDLNRVLNETRSQYEA,    SEQ ID NO:4548
RLNVEVDAAPTVDLNQVLNETRNQYEA,    SEQ ID NO:4549
RLNVEVDTAPTVDLNQVLNETRNQYEA,    SEQ ID NO:4550
RLNVEVDAAPTVDLNRVLNETRNQYEA,    SEQ ID NO:4551
RLNVEVDTAPTVDLNRVLNETRNQYEA,    SEQ ID NO:4552
LNVEVDAAPTVDLNQVLNETRSQYEAL,    SEQ ID NO:4553
LNVEVDTAPTVDLNQVLNETRSQYEAL,    SEQ ID NO:4554
LNVEVDAAPTVDLNRVLNETRSQYEAL,    SEQ ID NO:4555
LNVEVDTAPTVDLNRVLNETRSQYEAL,    SEQ ID NO:4556
LNVEVDAAPTVDLNQVLNETRNQYEAL,    SEQ ID NO:4557
LNVEVDTAPTVDLNQVLNETRNQYEAL,    SEQ ID NO:4558
LNVEVDAAPTVDLNRVLNETRNQYEAL,    SEQ ID NO:4559
LNVEVDTAPTVDLNRVLNETRNQYEAL,    SEQ ID NO:4560
EVNTLRCQLGDRLNVEVDAAPTVDLNQV,   SEQ ID NO:4561
EVNTLRSQLGDRLNVEVDAAPTVDLNQV,   SEQ ID NO:4562
EVNTLRCPLGDRLNVEVDAAPTVDLNQV,   SEQ ID NO:4563
EVNTLRSPLGDRLNVEVDAAPTVDLNQV,   SEQ ID NO:4564
EVNTLRCQLGDRLNVEVDTAPTVDLNQV,   SEQ ID NO:4565
EVNTLRSQLGDRLNVEVDTAPTVDLNQV,   SEQ ID NO:4566
EVNTLRCPLGDRLNVEVDTAPTVDLNQV,   SEQ ID NO:4567
EVNTLRSPLGDRLNVEVDTAPTVDLNQV,   SEQ ID NO:4568
EVNTLRCQLGDRLNVEVDAAPTVDLNRV,   SEQ ID NO:4569
EVNTLRSQLGDRLNVEVDAAPTVDLNRV,   SEQ ID NO:4570
EVNTLRCPLGDRLNVEVDAAPTVDLNRV,   SEQ ID NO:4571
EVNTLRSPLGDRLNVEVDAAPTVDLNRV,   SEQ ID NO:4572
EVNTLRCQLGDRLNVEVDTAPTVDLNRV,   SEQ ID NO:4573
EVNTLRSQLGDRLNVEVDTAPTVDLNRV,   SEQ ID NO:4574
EVNTLRCPLGDRLNVEVDTAPTVDLNRV,   SEQ ID NO:4575
EVNTLRSPLGDRLNVEVDTAPTVDLNRV,   SEQ ID NO:4576
VNTLRCQLGDRLNVEVDAAPTVDLNQVL,   SEQ ID NO:4577
VNTLRSQLGDRLNVEVDAAPTVDLNQVL,   SEQ ID NO:4578
VNTLRCPLGDRLNVEVDAAPTVDLNQVL,   SEQ ID NO:4579
VNTLRSPLGDRLNVEVDAAPTVDLNQVL,   SEQ ID NO:4580
VNTLRCQLGDRLNVEVDTAPTVDLNQVL,   SEQ ID NO:4581
```

-continued

| Sequence | SEQ ID NO: |
|---|---|
| VNTLRSQLGDRLNVEVDTAPTVDLNQVL, | SEQ ID NO:4582 |
| VNTLRCPLGDRLNVEVDTAPTVDLNQVL, | SEQ ID NO:4583 |
| VNTLRSPLGDRLNVEVDTAPTVDLNQVL, | SEQ ID NO:4584 |
| VNTLRCQLGDRLNVEVDAAPTVDLNRVL, | SEQ ID NO:4585 |
| VNTLRSQLGDRLNVEVDAAPTVDLNRVL, | SEQ ID NO:4586 |
| VNTLRCPLGDRLNVEVDAAPTVDLNRVL, | SEQ ID NO:4587 |
| VNTLRSPLGDRLNVEVDAAPTVDLNRVL, | SEQ ID NO:4588 |
| VNTLRCQLGDRLNVEVDTAPTVDLNRVL, | SEQ ID NO:4589 |
| VNTLRSQLGDRLNVEVDTAPTVDLNRVL, | SEQ ID NO:4590 |
| VNTLRCPLGDRLNVEVDTAPTVDLNRVL, | SEQ ID NO:4591 |
| VNTLRSPLGDRLNVEVDTAPTVDLNRVL, | SEQ ID NO:4592 |
| NTLRCQLGDRLNVEVDAAPTVDLNQVLN, | SEQ ID NO:4593 |
| NTLRSQLGDRLNVEVDAAPTVDLNQVLN, | SEQ ID NO:4594 |
| NTLRCPLGDRLNVEVDAAPTVDLNQVLN, | SEQ ID NO:4595 |
| NTLRSPLGDRLNVEVDAAPTVDLNQVLN, | SEQ ID NO:4596 |
| NTLRCQLGDRLNVEVDTAPTVDLNQVLN, | SEQ ID NO:4597 |
| NTLRSQLGDRLNVEVDTAPTVDLNQVLN, | SEQ ID NO:4598 |
| NTLRCPLGDRLNVEVDTAPTVDLNQVLN, | SEQ ID NO:4599 |
| NTLRSPLGDRLNVEVDTAPTVDLNQVLN, | SEQ ID NO:4600 |
| NTLRCQLGDRLNVEVDAAPTVDLNRVLN, | SEQ ID NO:4601 |
| NTLRSQLGDRLNVEVDAAPTVDLNRVLN, | SEQ ID NO:4602 |
| NTLRCPLGDRLNVEVDAAPTVDLNRVLN, | SEQ ID NO:4603 |
| NTLRSPLGDRLNVEVDAAPTVDLNRVLN, | SEQ ID NO:4604 |
| NTLRCQLGDRLNVEVDTAPTVDLNRVLN, | SEQ ID NO:4605 |
| NTLRSQLGDRLNVEVDTAPTVDLNRVLN, | SEQ ID NO:4606 |
| NTLRCPLGDRLNVEVDTAPTVDLNRVLN, | SEQ ID NO:4607 |
| NTLRSPLGDRLNVEVDTAPTVDLNRVLN, | SEQ ID NO:4608 |
| TLRCQLGDRLNVEVDAAPTVDLNQVLNE, | SEQ ID NO:4609 |
| TLRSQLGDRLNVEVDAAPTVDLNQVLNE, | SEQ ID NO:4610 |
| TLRCPLGDRLNVEVDAAPTVDLNQVLNE, | SEQ ID NO:4611 |
| TLRSPLGDRLNVEVDAAPTVDLNQVLNE, | SEQ ID NO:4612 |
| TLRCQLGDRLNVEVDTAPTVDLNQVLNE, | SEQ ID NO:4613 |
| TLRSQLGDRLNVEVDTAPTVDLNQVLNE, | SEQ ID NO:4614 |
| TLRCPLGDRLNVEVDTAPTVDLNQVLNE, | SEQ ID NO:4615 |
| TLRSPLGDRLNVEVDTAPTVDLNQVLNE, | SEQ ID NO:4616 |
| TLRCQLGDRLNVEVDAAPTVDLNRVLNE, | SEQ ID NO:4617 |
| TLRSQLGDRLNVEVDAAPTVDLNRVLNE, | SEQ ID NO:4618 |
| TLRCPLGDRLNVEVDAAPTVDLNRVLNE, | SEQ ID NO:4619 |
| TLRSPLGDRLNVEVDAAPTVDLNRVLNE, | SEQ ID NO:4620 |
| TLRCQLGDRLNVEVDTAPTVDLNRVLNE, | SEQ ID NO:4621 |
| TLRSQLGDRLNVEVDTAPTVDLNRVLNE, | SEQ ID NO:4622 |
| TLRCPLGDRLNVEVDTAPTVDLNRVLNE, | SEQ ID NO:4623 |
| TLRSPLGDRLNVEVDTAPTVDLNRVLNE, | SEQ ID NO:4624 |
| LRCQLGDRLNVEVDAAPTVDLNQVLNET, | SEQ ID NO:4625 |
| LRSQLGDRLNVEVDAAPTVDLNQVLNET, | SEQ ID NO:4626 |
| LRCPLGDRLNVEVDAAPTVDLNQVLNET, | SEQ ID NO:4627 |
| LRSPLGDRLNVEVDAAPTVDLNQVLNET, | SEQ ID NO:4628 |
| LRCQLGDRLNVEVDTAPTVDLNQVLNET, | SEQ ID NO:4629 |
| LRSQLGDRLNVEVDTAPTVDLNQVLNET, | SEQ ID NO:4630 |
| LRCPLGDRLNVEVDTAPTVDLNQVLNET, | SEQ ID NO:4631 |
| LRSPLGDRLNVEVDTAPTVDLNQVLNET, | SEQ ID NO:4632 |
| LRCQLGDRLNVEVDAAPTVDLNRVLNET, | SEQ ID NO:4633 |
| LRSQLGDRLNVEVDAAPTVDLNRVLNET, | SEQ ID NO:4634 |
| LRCPLGDRLNVEVDAAPTVDLNRVLNET, | SEQ ID NO:4635 |
| LRSPLGDRLNVEVDAAPTVDLNRVLNET, | SEQ ID NO:4636 |
| LRCQLGDRLNVEVDTAPTVDLNRVLNET, | SEQ ID NO:4637 |
| LRSQLGDRLNVEVDTAPTVDLNRVLNET, | SEQ ID NO:4638 |
| LRCPLGDRLNVEVDTAPTVDLNRVLNET, | SEQ ID NO:4639 |
| LRSPLGDRLNVEVDTAPTVDLNRVLNET, | SEQ ID NO:4640 |
| RCQLGDRLNVEVDAAPTVDLNQVLNETR, | SEQ ID NO:4641 |
| RSQLGDRLNVEVDAAPTVDLNQVLNETR, | SEQ ID NO:4642 |
| RCPLGDRLNVEVDAAPTVDLNQVLNETR, | SEQ ID NO:4643 |
| RSPLGDRLNVEVDAAPTVDLNQVLNETR, | SEQ ID NO:4644 |
| RCQLGDRLNVEVDTAPTVDLNQVLNETR, | SEQ ID NO:4645 |
| RSQLGDRLNVEVDTAPTVDLNQVLNETR, | SEQ ID NO:4646 |
| RCPLGDRLNVEVDTAPTVDLNQVLNETR, | SEQ ID NO:4647 |
| RSPLGDRLNVEVDTAPTVDLNQVLNETR, | SEQ ID NO:4648 |
| RCQLGDRLNVEVDAAPTVDLNRVLNETR, | SEQ ID NO:4649 |
| RSQLGDRLNVEVDAAPTVDLNRVLNETR, | SEQ ID NO:4650 |
| RCPLGDRLNVEVDAAPTVDLNRVLNETR, | SEQ ID NO:4651 |
| RSPLGDRLNVEVDAAPTVDLNRVLNETR, | SEQ ID NO:4652 |
| RCQLGDRLNVEVDTAPTVDLNRVLNETR, | SEQ ID NO:4653 |
| RSQLGDRLNVEVDTAPTVDLNRVLNETR, | SEQ ID NO:4654 |
| RCPLGDRLNVEVDTAPTVDLNRVLNETR, | SEQ ID NO:4655 |
| RSPLGDRLNVEVDTAPTVDLNRVLNETR, | SEQ ID NO:4656 |
| CQLGDRLNVEVDAAPTVDLNQVLNETRS, | SEQ ID NO:4657 |
| SQLGDRLNVEVDAAPTVDLNQVLNETRS, | SEQ ID NO:4658 |
| CPLGDRLNVEVDAAPTVDLNQVLNETRS, | SEQ ID NO:4659 |
| SPLGDRLNVEVDAAPTVDLNQVLNETRS, | SEQ ID NO:4660 |
| CQLGDRLNVEVDTAPTVDLNQVLNETRS, | SEQ ID NO:4661 |

-continued

```
SQLGDRLNVEVDTAPTVDLNQVLNETRS,   SEQ ID NO:4662
CPLGDRLNVEVDTAPTVDLNQVLNETRS,   SEQ ID NO:4663
SPLGDRLNVEVDTAPTVDLNQVLNETRS,   SEQ ID NO:4664
CQLGDRLNVEVDAAPTVDLNRVLNETRS,   SEQ ID NO:4665
SQLGDRLNVEVDAAPTVDLNRVLNETRS,   SEQ ID NO:4666
CPLGDRLNVEVDAAPTVDLNRVLNETRS,   SEQ ID NO:4667
SPLGDRLNVEVDAAPTVDLNRVLNETRS,   SEQ ID NO:4668
CQLGDRLNVEVDTAPTVDLNRVLNETRS,   SEQ ID NO:4669
SQLGDRLNVEVDTAPTVDLNRVLNETRS,   SEQ ID NO:4670
CPLGDRLNVEVDTAPTVDLNRVLNETRS,   SEQ ID NO:4671
SPLGDRLNVEVDTAPTVDLNRVLNETRS,   SEQ ID NO:4672
CQLGDRLNVEVDAAPTVDLNQVLNETRN,   SEQ ID NO:4673
SQLGDRLNVEVDAAPTVDLNQVLNETRN,   SEQ ID NO:4674
CPLGDRLNVEVDAAPTVDLNQVLNETRN,   SEQ ID NO:4675
SPLGDRLNVEVDAAPTVDLNQVLNETRN,   SEQ ID NO:4676
CQLGDRLNVEVDTAPTVDLNQVLNETRN,   SEQ ID NO:4677
SQLGDRLNVEVDTAPTVDLNQVLNETRN,   SEQ ID NO:4678
CPLGDRLNVEVDTAPTVDLNQVLNETRN,   SEQ ID NO:4679
SPLGDRLNVEVDTAPTVDLNQVLNETRN,   SEQ ID NO:4680
CQLGDRLNVEVDAAPTVDLNRVLNETRN,   SEQ ID NO:4681
SQLGDRLNVEVDAAPTVDLNRVLNETRN,   SEQ ID NO:4682
CPLGDRLNVEVDAAPTVDLNRVLNETRN,   SEQ ID NO:4683
SPLGDRLNVEVDAAPTVDLNRVLNETRN,   SEQ ID NO:4684
CQLGDRLNVEVDTAPTVDLNRVLNETRN,   SEQ ID NO:4685
SQLGDRLNVEVDTAPTVDLNRVLNETRN,   SEQ ID NO:4686
CPLGDRLNVEVDTAPTVDLNRVLNETRN,   SEQ ID NO:4687
SPLGDRLNVEVDTAPTVDLNRVLNETRN,   SEQ ID NO:4688
QLGDRLNVEVDAAPTVDLNQVLNETRSQ,   SEQ ID NO:4689
PLGDRLNVEVDAAPTVDLNQVLNETRSQ,   SEQ ID NO:4690
QLGDRLNVEVDTAPTVDLNQVLNETRSQ,   SEQ ID NO:4691
PLGDRLNVEVDTAPTVDLNQVLNETRSQ,   SEQ ID NO:4692
QLGDRLNVEVDAAPTVDLNRVLNETRSQ,   SEQ ID NO:4693
PLGDRLNVEVDAAPTVDLNRVLNETRSQ,   SEQ ID NO:4694
QLGDRLNVEVDTAPTVDLNRVLNETRSQ,   SEQ ID NO:4695
PLGDRLNVEVDTAPTVDLNRVLNETRSQ,   SEQ ID NO:4696
QLGDRLNVEVDAAPTVDLNQVLNETRNQ,   SEQ ID NO:4697
PLGDRLNVEVDAAPTVDLNQVLNETRNQ,   SEQ ID NO:4698
QLGDRLNVEVDTAPTVDLNQVLNETRNQ,   SEQ ID NO:4699
PLGDRLNVEVDTAPTVDLNQVLNETRNQ,   SEQ ID NO:4700
QLGDRLNVEVDAAPTVDLNRVLNETRNQ,   SEQ ID NO:4701
PLGDRLNVEVDAAPTVDLNRVLNETRNQ,   SEQ ID NO:4702
QLGDRLNVEVDTAPTVDLNRVLNETRNQ,   SEQ ID NO:4703
PLGDRLNVEVDTAPTVDLNRVLNETRNQ,   SEQ ID NO:4704
LGDRLNVEVDAAPTVDLNQVLNETRSQY,   SEQ ID NO:4705
LGDRLNVEVDTAPTVDLNQVLNETRSQY,   SEQ ID NO:4706
LGDRLNVEVDAAPTVDLNRVLNETRSQY,   SEQ ID NO:4707
LGDRLNVEVDTAPTVDLNRVLNETRSQY,   SEQ ID NO:4708
LGDRLNVEVDAAPTVDLNQVLNETRNQY,   SEQ ID NO:4709
LGDRLNVEVDTAPTVDLNQVLNETRNQY,   SEQ ID NO:4710
LGDRLNVEVDAAPTVDLNRVLNETRNQY,   SEQ ID NO:4711
LGDRLNVEVDTAPTVDLNRVLNETRNQY,   SEQ ID NO:4712
GDRLNVEVDAAPTVDLNQVLNETRSQYE,   SEQ ID NO:4713
GDRLNVEVDTAPTVDLNQVLNETRSQYE,   SEQ ID NO:4714
GDRLNVEVDAAPTVDLNRVLNETRSQYE,   SEQ ID NO:4715
GDRLNVEVDTAPTVDLNRVLNETRSQYE,   SEQ ID NO:4716
GDRLNVEVDAAPTVDLNQVLNETRNQYE,   SEQ ID NO:4717
GDRLNVEVDTAPTVDLNQVLNETRNQYE,   SEQ ID NO:4718
GDRLNVEVDAAPTVDLNRVLNETRNQYE,   SEQ ID NO:4719
GDRLNVEVDTAPTVDLNRVLNETRNQYE,   SEQ ID NO:4720
DRLNVEVDAAPTVDLNQVLNETRSQYEA,   SEQ ID NO:4721
DRLNVEVDTAPTVDLNQVLNETRSQYEA,   SEQ ID NO:4722
DRLNVEVDAAPTVDLNRVLNETRSQYEA,   SEQ ID NO:4723
DRLNVEVDTAPTVDLNRVLNETRSQYEA,   SEQ ID NO:4724
DRLNVEVDAAPTVDLNQVLNETRNQYEA,   SEQ ID NO:4725
DRLNVEVDTAPTVDLNQVLNETRNQYEA,   SEQ ID NO:4726
DRLNVEVDAAPTVDLNRVLNETRNQYEA,   SEQ ID NO:4727
DRLNVEVDTAPTVDLNRVLNETRNQYEA,   SEQ ID NO:4728
RLNVEVDAAPTVDLNQVLNETRSQYEAL,   SEQ ID NO:4729
RLNVEVDTAPTVDLNQVLNETRSQYEAL,   SEQ ID NO:4730
RLNVEVDAAPTVDLNRVLNETRSQYEAL,   SEQ ID NO:4731
RLNVEVDTAPTVDLNRVLNETRSQYEAL,   SEQ ID NO:4732
RLNVEVDAAPTVDLNQVLNETRNQYEAL,   SEQ ID NO:4733
RLNVEVDTAPTVDLNQVLNETRNQYEAL,   SEQ ID NO:4734
RLNVEVDAAPTVDLNRVLNETRNQYEAL,   SEQ ID NO:4735
RLNVEVDTAPTVDLNRVLNETRNQYEAL,   SEQ ID NO:4736
EVNTLRCQLGDRLNVEVDAAPTVDLNQVL,  SEQ ID NO:4737
EVNTLRSQLGDRLNVEVDAAPTVDLNQVL,  SEQ ID NO:4738
EVINTLRCPLGDRLNVEVDAAPTVDLNQVL, SEQ ID NO:4739
EVNTLRSPLGDRLNVEVDAAPTVDLNQVL,  SEQ ID NO:4740
EVNTLRCQLGDRLNVEVDTAPTVDLNQVL,  SEQ ID NO:4741
```

-continued

```
EVNTLRSQLGDRLNVEVDTAPTVDLNQVL,   SEQ ID NO:4742
EVNTLRCPLGDRLNVEVDTAPTVDLNQVL,   SEQ ID NO:4743
EVNTLRSPLGDRLNVEVDTAPTVDLNQVL,   SEQ ID NO:4744
EVNTLRCQLGDRLNVEVDAAPTVDLNRVL,   SEQ ID NO:4745
EVNTLRSQLGDRLNVEVDAAPTVDLNRVL,   SEQ ID NO:4746
EVNTLRCPLGDRLNVEVDAAPTVDLNRVL,   SEQ ID NO:4747
EVNTLRSPLGDRLNVEVDAAPTVDLNRVL,   SEQ ID NO:4748
EVNTLRCQLGDRLNVEVDTAPTVDLNRVL,   SEQ ID NO:4749
EVNTLRSQLGDRLNVEVDTAPTVDLNRVL,   SEQ ID NO:4750
EVNTLRCPLGDRLNVEVDTAPTVDLNRVL,   SEQ ID NO:4751
EVNTLRSPLGDRLNVEVDTAPTVDLNRVL,   SEQ ID NO:4752
VNTLRCQLGDRLNVEVDAAPTVDLNQVLN,   SEQ ID NO:4753
VNTLRSQLGDRLNVEVDAAPTVDLNQVLN,   SEQ ID NO:4754
VNTLRCPLGDRLNVEVDAAPTVDLNQVLN,   SEQ ID NO:4755
VNTLRSPLGDRLNVEVDAAPTVDLNQVLN,   SEQ ID NO:4756
VNTLRCQLGDRLNVEVDTAPTVDLNQVLN,   SEQ ID NO:4757
VNTLRSQLGDRLNVEVDTAPTVDLNQVLN,   SEQ ID NO:4758
VNTLRCPLGDRLNVEVDTAPTVDLNQVLN,   SEQ ID NO:4759
VNTLRSPLGDRLNVEVDTAPTVDLNQVLN,   SEQ ID NO:4760
VNTLRCQLGDRLNVEVDAAPTVDLNRVLN,   SEQ ID NO:4761
VNTLRSQLGDRLNVEVDAAPTVDLNRVLN,   SEQ ID NO:4762
VNTLRCPLGDRLNVEVDAAPTVDLNRVLN,   SEQ ID NO:4763
VNTLRSPLGDRLNVEVDAAPTVDLNRVLN,   SEQ ID NO:4764
VNTLRCQLGDRLNVEVDTAPTVDLNRVLN,   SEQ ID NO:4765
VNTLRSQLGDRLNVEVDTAPTVDLNRVLN,   SEQ ID NO:4766
VNTLRCPLGDRLNVEVDTAPTVDLNRVLN,   SEQ ID NO:4767
VNTLRSPLGDRLNVEVDTAPTVDLNRVLN,   SEQ ID NO:4768
NTLRCQLGDRLNVEVDAAPTVDLNQVLNE,   SEQ ID NO:4769
NTLRSQLGDRLNVEVDAAPTVDLNQVLNE,   SEQ ID NO:4770
NTLRCPLGDRLNVEVDAAPTVDLNQVLNE,   SEQ ID NO:4771
NTLRSPLGDRLNVEVDAAPTVDLNQVLNE,   SEQ ID NO:4772
NTLRCQLGDRLNVEVDTAPTVDLNQVLNE,   SEQ ID NO:4773
NTLRSQLGDRLNVEVDTAPTVDLNQVLNE,   SEQ ID NO:4774
NTLRCPLGDRLNVEVDTAPTVDLNQVLNE,   SEQ ID NO:4775
NTLRSPLGDRLNVEVDTAPTVDLNQVLNE,   SEQ ID NO:4776
NTLRCQLGDRLNVEVDAAPTVDLNRVLNE,   SEQ ID NO:4777
NTLRSQLGDRLNVEVDAAPTVDLNRVLNE,   SEQ ID NO:4778
NTLRCPLGDRLNVEVDAAPTVDLNRVLNE,   SEQ ID NO:4779
NTLRSPLGDRLNVEVDAAPTVDLNRVLNE,   SEQ ID NO:4780
NTLRCQLGDRLNVEVDTAPTVDLNRVLNE,   SEQ ID NO:4781
NTLRSQLGDRLNVEVDTAPTVDLNRVLNE,   SEQ ID NO:4782
NTLRCPLGDRLNVEVDTAPTVDLNRVLNE,   SEQ ID NO:4783
NTLRSPLGDRLNVEVDTAPTVDLNRVLNE,   SEQ ID NO:4784
TLRCQLGDRLNVEVDAAPTVDLNQVLNET,   SEQ ID NO:4785
TLRSQLGDRLNVEVDAAPTVDLNQVLNET,   SEQ ID NO:4786
TLRCPLGDRLNVEVDAAPTVDLNQVLNET,   SEQ ID NO:4787
TLRSPLGDRLNVEVDAAPTVDLNQVLNET,   SEQ ID NO:4788
TLRCQLGDRLNVEVDTAPTVDLNQVLNET,   SEQ ID NO:4789
TLRSQLGDRLNVEVDTAPTVDLNQVLNET,   SEQ ID NO:4790
TLRCPLGDRLNVEVDTAPTVDLNQVLNET,   SEQ ID NO:4791
TLRSPLGDRLNVEVDTAPTVDLNQVLNET,   SEQ ID NO:4792
TLRCQLGDRLNVEVDAAPTVDLNRVLNET,   SEQ ID NO:4793
TLRSQLGDRLNVEVDAAPTVDLNRVLNET,   SEQ ID NO:4794
TLRCPLGDRLNVEVDAAPTVDLNRVLNET,   SEQ ID NO:4795
TLRSPLGDRLNVEVDAAPTVDLNRVLNET,   SEQ ID NO:4796
TLRCQLGDRLNVEVDTAPTVDLNRVLNET,   SEQ ID NO:4797
TLRSQLGDRLNVEVDTAPTVDLNRVLNET,   SEQ ID NO:4798
TLRCPLGDRLNVEVDTAPTVDLNRVLNET,   SEQ ID NO:4799
TLRSPLGDRLNVEVDTAPTVDLNRVLNET,   SEQ ID NO:4800
LRCQLGDRLNVEVDAAPTVDLNQVLNETR,   SEQ ID NO:4801
LRSQLGDRLNVEVDAAPTVDLNQVLNETR,   SEQ ID NO:4802
LRCPLGDRLNVEVDAAPTVDLNQVLNETR,   SEQ ID NO:4803
LRSPLGDRLNVEVDAAPTVDLNQVLNETR,   SEQ ID NO:4804
LRCQLGDRLNVEVDTAPTVDLNQVLNETR,   SEQ ID NO:4805
LRSQLGDRLNVEVDTAPTVDLNQVLNETR,   SEQ ID NO:4806
LRCPLGDRLNVEVDTAPTVDLNQVLNETR,   SEQ ID NO:4807
LRSPLGDRLNVEVDTAPTVDLNQVLNETR,   SEQ ID NO:4808
LRCQLGDRLNVEVDAAPTVDLNRVLNETR,   SEQ ID NO:4809
LRSQLGDRLNVEVDAAPTVDLNRVLNETR,   SEQ ID NO:4810
LRCPLGDRLNVEVDAAPTVDLNRVLNETR,   SEQ ID NO:4811
LRSPLGDRLNVEVDAAPTVDLNRVLNETR,   SEQ ID NO:4812
LRCQLGDRLNVEVDTAPTVDLNRVLNETR,   SEQ ID NO:4813
LRSQLGDRLNVEVDTAPTVDLNRVLNETR,   SEQ ID NO:4814
LRCPLGDRLNVEVDTAPTVDLNRVLNETR,   SEQ ID NO:4815
LRSPLGDRLNVEVDTAPTVDLNRVLNETR,   SEQ ID NO:4816
RCQLGDRLNVEVDAAPTVDLNQVLNETRS,   SEQ ID NO:4817
RSQLGDRLNVEVDAAPTVDLNQVLNETRS,   SEQ ID NO:4818
RCPLGDRLNVEVDAAPTVDLNQVLNETRS,   SEQ ID NO:4819
RSPLGDRLNVEVDAAPTVDLNQVLNETRS,   SEQ ID NO:4820
RCQLGDRLNVEVDTAPTVDLNQVLNETRS,   SEQ ID NO:4821
```

-continued

```
RSQLGDRLNVEVDTAPTVDLNQVLNETRS, SEQ ID NO:4822
RCPLGDRLNVEVDTAPTVDLNQVLNETRS, SEQ ID NO:4823
RSPLGDRLNVEVDTAPTVDLNQVLNETRS, SEQ ID NO:4824
RCQLGDRLNVEVDAAPTVDLNRVLNETRS, SEQ ID NO:4825
RSQLGDRLNVEVDAAPTVDLNRVLNETRS, SEQ ID NO:4826
RCPLGDRLNVEVDAAPTVDLNRVLNETRS, SEQ ID NO:4827
RSPLGDRLNVEVDAAPTVDLNRVLNETRS, SEQ ID NO:4828
RCQLGDRLNVEVDTAPTVDLNRVLNETRS, SEQ ID NO:4829
RSQLGDRLNVEVDTAPTVDLNRVLNETRS, SEQ ID NO:4830
RCPLGDRLNVEVDTAPTVDLNRVLNETRS, SEQ ID NO:4831
RSPLGDRLNVEVDTAPTVDLNRVLNETRS, SEQ ID NO:4832
RCQLGDRLNVEVDAAPTVDLNQVLNETRN, SEQ ID NO:4833
RSQLGDRLNVEVDAAPTVDLNQVLNETRN, SEQ ID NO:4834
RCPLGDRLNVEVDAAPTVDLNQVLNETRN, SEQ ID NO:4835
RSPLGDRLNVEVDAAPTVDLNQVLNETRN, SEQ ID NO:4836
RCQLGDRLNVEVDTAPTVDLNQVLNETRN, SEQ ID NO:4837
RSQLGDRLNVEVDTAPTVDLNQVLNETRN, SEQ ID NO:4838
RCPLGDRLNVEVDTAPTVDLNQVLNETRN, SEQ ID NO:4839
RSPLGDRLNVEVDTAPTVDLNQVLNETRN, SEQ ID NO:4840
RCQLGDRLNVEVDAAPTVDLNRVLNETRN, SEQ ID NO:4841
RSQLGDRLNVEVDAAPTVDLNRVLNETRN  SEQ ID NO:4842
RCPLGDRLNVEVDAAPTVDLNRVLNETRN, SEQ ID NO:4843
RSPLGDRLNVEVDAAPTVDLNRVLNETRN, SEQ ID NO:4844
RCQLGDRLNVEVDTAPTVDLNRVLNETRN, SEQ ID NO:4845
RSQLGDRLNVEVDTAPTVDLNRVLNETRN, SEQ ID NO:4846
RCPLGDRLNVEVDTAPTVDLNRVLNETRN, SEQ ID NO:4847
RSPLGDRLNVEVDTAPTVDLNRVLNETRN, SEQ ID NO:4848
CQLGDRLNVEVDAAPTVDLNQVLNETRSQ, SEQ ID NO:4849
SQLGDRLNVEVDAAPTVDLNQVLNETRSQ, SEQ ID NO:4850
CPLGDRLNVEVDAAPTVDLNQVLNETRSQ, SEQ ID NO:4851
SPLGDRLNVEVDAAPTVDLNQVLNETRSQ, SEQ ID NO:4852
CQLGDRLNVEVDTAPTVDLNQVLNETRSQ, SEQ ID NO:4853
SQLGDRLNVEVDTAPTVDLNQVLNETRSQ, SEQ ID NO:4854
CPLGDRLNVEVDTAPTVDLNQVLNETRSQ, SEQ ID NO:4855
SPLGDRLNVEVDTAPTVDLNQVLNETRSQ, SEQ ID NO:4856
CQLGDRLNVEVDAAPTVDLNRVLNETRSQ, SEQ ID NO:4857
SQLGDRLNVEVDAAPTVDLNRVLNETRSQ, SEQ ID NO:4858
CPLGDRLNVEVDAAPTVDLNRVLNETRSQ, SEQ ID NO:4859
SPLGDRLNVEVDAAPTVDLNRVLNETRSQ, SEQ ID NO:4860
CQLGDRLNVEVDTAPTVDLNRVLNETRSQ, SEQ ID NO:4861
SQLGDRLNVEVDTAPTVDLNRVLNETRSQ, SEQ ID NO:4862
CPLGDRLNVEVDTAPTVDLNRVLNETRSQ, SEQ ID NO:4863
SPLGDRLNVEVDTAPTVDLNRVLNETRSQ, SEQ ID NO:4864
CQLGDRLNVEVDAAPTVDLNQVLNETRNQ, SEQ ID NO:4865
SQLGDRLNVEVDAAPTVDLNQVLNETRNQ, SEQ ID NO:4866
CPLGDRLNVEVDAAPTVDLNQVLNETRNQ, SEQ ID NO:4867
SPLGDRLNVEVDAAPTVDLNQVLNETRNQ, SEQ ID NO:4868
CQLGDRLNVEVDTAPTVDLNQVLNETRNQ, SEQ ID NO:4869
SQLGDRLNVEVDTAPTVDLNQVLNETRNQ, SEQ ID NO:4870
CPLGDRLNVEVDTAPTVDLNQVLNETRNQ, SEQ ID NO:4871
SPLGDRLNVEVDTAPTVDLNQVLNETRNQ, SEQ ID NO:4872
CQLGDRLNVEVDAAPTVDLNRVLNETRNQ, SEQ ID NO:4873
SQLGDRLNVEVDAAPTVDLNRVLNETRNQ, SEQ ID NO:4874
CPLGDRLNVEVDAAPTVDLNRVLNETRNQ, SEQ ID NO:4875
SPLGDRLNVEVDAAPTVDLNRVLNETRNQ, SEQ ID NO:4876
CQLGDRLNVEVDTAPTVDLNRVLNETRNQ, SEQ ID NO:4877
SQLGDRLNVEVDTAPTVDLNRVLNETRNQ, SEQ ID NO:4878
CPLGDRLNVEVDTAPTVDLNRVLNETRNQ, SEQ ID NO:4879
SPLGDRLNVEVDTAPTVDLNRVLNETRNQ, SEQ ID NO:4880
QLGDRLNVEVDAAPTVDLNQVLNETRSQY, SEQ ID NO:4881
PLGDRLNVEVDAAPTVDLNQVLNETRSQY, SEQ ID NO:4882
QLGDRLNVEVDTAPTVDLNQVLNETRSQY, SEQ ID NO:4883
PLGDRLNVEVDTAPTVDLNQVLNETRSQY, SEQ ID NO:4884
QLGDRLNVEVDAAPTVDLNRVLNETRSQY, SEQ ID NO:4885
PLGDRLNVEVDAAPTVDLNRVLNETRSQY, SEQ ID NO:4886
QLGDRLNVEVDTAPTVDLNRVLNETRSQY, SEQ ID NO:4887
PLGDRLNVEVDTAPTVDLNRVLNETRSQY, SEQ ID NO:4888
QLGDRLNVEVDAAPTVDLNQVLNETRNQY, SEQ ID NO:4889
PLGDRLNVEVDAAPTVDLNQVLNETRNQY, SEQ ID NO:4890
QLGDRLNVEVDTAPTVDLNQVLNETRNQY, SEQ ID NO:4891
PLGDRLNVEVDTAPTVDLNQVLNETRNQY, SEQ ID NO:4892
QLGDRLNVEVDAAPTVDLNRVLNETRNQY, SEQ ID NO:4893
PLGDRLNVEVDAAPTVDLNRVLNETRNQY, SEQ ID NO:4894
QLGDRLNVEVDTAPTVDLNRVLNETRNQY, SEQ ID NO:4895
PLGDRLNVEVDTAPTVDLNRVLNETRNQY, SEQ ID NO:4896
LGDRLNVEVDAAPTVDLNQVLNETRSQYE, SEQ ID NO:4897
LGDRLNVEVDTAPTVDLNQVLNETRSQYE, SEQ ID NO:4898
LGDRLNVEVDAAPTVDLNRVLNETRSQYE, SEQ ID NO:4899
LGDRLNVEVDTAPTVDLNRVLNETRSQYE, SEQ ID NO:4900
LGDRLNVEVDAAPTVDLNQVLNETRNQYE, SEQ ID NO:4901
```

```
                                                    -continued
LGDRLNVEVDTAPTVDLNQVLNETRNQYE, SEQ ID NO:4902
LGDRLNVEVDAAPTVDLNRVLNETRNQYE, SEQ ID NO:4903
LGDRLNVEVDTAPTVDLNRVLNETRNQYE, SEQ ID NO:4904
GDRLNVEVDAAPTVDLNQVLNETRSQYEA, SEQ ID NO:4905
GDRLNVEVDTAPTVDLNQVLNETRSQYEA, SEQ ID NO:4906
GDRLNVEVDAAPTVDLNRVLNETRSQYEA, SEQ ID NO:4907
GDRLNVEVDTAPTVDLNRVLNETRSQYEA, SEQ ID NO:4908
GDRLNVEVDAAPTVDLNQVLNETRNQYEA, SEQ ID NO:4909
GDRLNVEVDTAPTVDLNQVLNETRNQYEA, SEQ ID NO:4910
GDRLNVEVDAAPTVDLNRVLNETRNQYEA, SEQ ID NO:4911
GDRLNVEVDTAPTVDLNRVLNETRNQYEA, SEQ ID NO:4912
DRLNVEVDAAPTVDLNQVLNETRSQYEAL, SEQ ID NO:4913
DRLNVEVDTAPTVDLNQVLNETRSQYEAL, SEQ ID NO:4914
DRLNVEVDAAPTVDLNRVLNETRSQYEAL, SEQ ID NO:4915
DRLNVEVDTAPTVDLNRVLNETRSQYEAL, SEQ ID NO:4916
DRLNVEVDAAPTVDLNQVLNETRNQYEAL, SEQ ID NO:4917
DRLNVEVDTAPTVDLNQVLNETRNQYEAL, SEQ ID NO:4918
DRLNVEVDAAPTVDLNRVLNETRNQYEAL, SEQ ID NO:4919
DRLNVEVDTAPTVDLNRVLNETRNQYEAL, SEQ ID NO:4920
EVNTLRCQLGDRLNVEVDAAPTVDLNQVLN, SEQ ID NO:4921
EVNTLRSQLGDRLNVEVDAAPTVDLNQVLN, SEQ ID NO:4922
EVNTLRCPLGDRLNVEVDAAPTVDLNQVLN, SEQ ID NO:4923
EVNTLRSPLGDRLNVEVDAAPTVDLNQVLN, SEQ ID NO:4924
EVNTLRCQLGDRLNVEVDTAPTVDLNQVLN, SEQ ID NO:4925
EVNTLRSQLGDRLNVEVDTAPTVDLNQVLN, SEQ ID NO:4926
EVNTLRCPLGDRLNVEVDTAPTVDLNQVLN, SEQ ID NO:4927
EVNTLRSPLGDRLNVEVDTAPTVDLNQVLN, SEQ ID NO:4928
EVNTLRCQLGDRLNVEVDAAPTVDLNRVLN, SEQ ID NO:4929
EVNTLRSQLGDRLNVEVDAAPTVDLNRVLN, SEQ ID NO:4930
EVNTLRCPLGDRLNVEVDAAPTVDLNRVLN, SEQ ID NO:4931
EVNTLRSPLGDRLNVEVDAAPTVDLNRVLN, SEQ ID NO:4932
EVNTLRCQLGDRLNVEVDTAPTVDLNRVLN, SEQ ID NO:4933
EVNTLRSQLGDRLNVEVDTAPTVDLNRVLN, SEQ ID NO:4934
EVNTLRCPLGDRLNVEVDTAPTVDLNRVLN, SEQ ID NO:4935
EVNTLRSPLGDRLNVEVDTAPTVDLNRVLN, SEQ ID NO:4936
VNTLRCQLGDRLNVEVDAAPTVDLNQVLNE, SEQ ID NO:4937
VNTLRSQLGDRLNVEVDAAPTVDLNQVLNE, SEQ 1D NO:4938
VNTLRCPLGDRLNVEVDAAPTVDLNQVLNE, SEQ ID NO:4939
VNTLRSPLGDRLNVEVDAAPTVDLNQVLNE, SEQ ID NO:4940
VNTLRCQLGDRLNVEVDTAPTVDLNQVLNE, SEQ ID NO:4941
VNTLRSQLGDRLNVEVDTAPTVDLNQVLNE, SEQ ID NO:4942
VNTLRCPLGDRLNVEVDTAPTVDLNQVLNE, SEQ ID NO:4943
VNTLRSPLGDRLNVEVDTAPTVDLNQVLNE, SEQ ID NO:4944
VNTLRCQLGDRLNVEVDAAPTVDLNRVLNE, SEQ ID NO:4945
VNTLRSQLGDRLNVEVDAAPTVDLNRVLNE, SEQ ID NO:4946
VNTLRCPLGDRLNVEVDAAPTVDLNRVLNE, SEQ ID NO:4947
VNTLRSPLGDRLNVEVDAAPTVDLNRVLNE, SEQ ID NO:4948
VNTLRCQLGDRLNVEVDTAPTVDLNRVLNE, SEQ ID NO:4949
VNTLRSQLGDRLNVEVDTAPTVDLNRVLNE, SEQ ID NO:4950
VNTLRCPLGDRLNVEVDTAPTVDLNRVLNE, SEQ ID NO:4951
VNTLRSPLGDRLNVEVDTAPTVDLNRVLNE, SEQ ID NO:4952
NTLRCQLGDRLNVEVDAAPTVDLNQVLNET, SEQ ID NO:4953
NTLRSQLGDRLNVEVDAAPTVDLNQVLNET, SEQ ID NO:4954
NTLRCPLGDRLNVEVDAAPTVDLNQVLNET, SEQ ID NO:4955
NTLRSPLGDRLNVEVDAAPTVDLNQVLNET, SEQ ID NO:4956
NTLRCQLGDRLNVEVDTAPTVDLNQVLNET, SEQ ID NO:4957
NTLRSQLGDRLNVEVDTAPTVDLNQVLNET, SEQ ID NO:4958
NTLRCPLGDRLNVEVDTAPTVDLNQVLNET, SEQ ID NO:4959
NTLRSPLGDRLNVEVDTAPTVDLNQVLNET, SEQ ID NO:4960
NTLRCQLGDRLNVEVDAAPTVDLNRVLNET, SEQ ID NO:4961
NTLRSQLGDRLNVEVDAAPTVDLNRVLNET, SEQ ID NO:4962
NTLRCPLGDRLNVEVDAAPTVDLNRVLNET, SEQ ID NO:4963
NTLRSPLGDRLNVEVDAAPTVDLNRVLNET, SEQ ID NO:4964
NTLRCQLGDRLNVEVDTAPTVDLNRVLNET, SEQ ID NO:4965
NTLRSQLGDRLNVEVDTAPTVDLNRVLNET, SEQ ID NO:4966
NTLRCPLGDRLNVEVDTAPTVDLNRVLNET, SEQ ID NO:4967
NTLRSPLGDRLNVEVDTAPTVDLNRVLNET, SEQ ID NO:4968
TLRCQLGDRLNVEVDAAPTVDLNQVLNETR, SEQ ID NO:4969
TLRSQLGDRLNVEVDAAPTVDLNQVLNETR, SEQ ID NO:4970
TLRCPLGDRLNVEVDAAPTVDLNQVLNETR, SEQ ID NO:4971
TLRSPLGDRLNVEVDAAPTVDLNQVLNETR, SEQ ID NO:4972
TLRCQLGDRLNVEVDTAPTVDLNQVLNETR, SEQ ID NO:4973
TLRSQLGDRLNVEVDTAPTVDLNQVLNETR, SEQ ID NO:4974
TLRCPLGDRLNVEVDTAPTVDLNQVLNETR, SEQ ID NO:4975
TLRSPLGDRLNVEVDTAPTVDLNQVLNETR, SEQ ID NO:4976
TLRCQLGDRLNVEVDAAPTVDLNRVLNETR, SEQ ID NO:4977
TLRSQLGDRLNVEVDAAPTVDLNRVLNETR, SEQ ID NO:4978
TLRCPLGDRLNVEVDAAPTVDLNRVLNETR, SEQ ID NO:4979
TLRSPLGDRLNVEVDAAPTVDLNRVLNETR, SEQ ID NO:4980
TLRCQLGDRLNVEVDTAPTVDLNRVLNETR, SEQ ID NO:4981
```

```
TLRSQLGDRLNVEVDTAPTVDLNRVLNETR,   SEQ ID NO:4982
TLRCPLGDRLNVEVDTAPTVDLNRVLNETR,   SEQ ID NO:4983
TLRSPLGDRLNVEVDTAPTVDLNRVLNETR,   SEQ ID NO:4984
LRCQLGDRLNVEVDAAPTVDLNQVLNETRS,   SEQ ID NO:4985
LRSQLGDRLNVEVDAAPTVDLNQVLNETRS,   SEQ ID NO:4986
LRCPLGDRLNVEVDAAPTVDLNQVLNETRS,   SEQ ID NO:4987
LRSPLGDRLNVEVDAAPTVDLNQVLNETRS,   SEQ ID NO:4988
LRCQLGDRLNVEVDTAPTVDLNQVLNETRS,   SEQ ID NO:4989
LRSQLGDRLNVEVDTAPTVDLNQVLNETRS,   SEQ ID NO:4900
LRCPLGDRLNVEVDTAPTVDLNQVLNETRS,   SEQ ID NO:4901
LRSPLGDRLNVEVDTAPTVDLNQVLNETRS,   SEQ ID NO:4902
LRCQLGDRLNVEVDAAPTVDLNRVLNETRS,   SEQ ID NO:4903
LRSQLGDRLNVEVDAAPTVDLNRVLNETRS,   SEQ ID NO:4904
LRCPLGDRLNYEVDAAPTVDLNRVLNETRS,   SEQ ID NO:4905
LRSPLGDRLNVEVDAAPTVDLNRVLNETRS,   SEQ ID NO:4906
LRCQLGDRLNVEVDTAPTVDLNRVLNETRS,   SEQ ID NO:4907
LRSQLGDRLNVEVDTAPTVDLNRVLNETRS,   SEQ ID NO:4908
LRCPLGDRLNVEVDTAPTVDLNRVLNETRS,   SEQ ID NO:4909
LRSPLGDRLNVEVDTAPTVDLNRVLNETRS,   SEQ ID NO:4910
LRCQLGDRLNVEVDAAPTVDLNQVLNETRN,   SEQ ID NO:4911
LRSQLGDRLNVEVDAAPTVDLNQVLNETRN,   SEQ ID NO:4912
LRCPLGDRLNVEVDAAPTVDLNQVLNETRN,   SEQ ID NO:4913
LRSPLGDRLNVEVDAAPTVDLNQVLNETRN,   SEQ ID NO:4914
LRCQLGDRLNVEVDTAPTVDLNQVLNETRN,   SEQ ID NO:4915
LRSQLGDRLNVEVDTAPTVDLNQVLNETRN,   SEQ ID NO:4916
LRCPLGDRLNVEVDTAPTVDLNQVLNETRN,   SEQ ID NO:4917
LRSPLGDRLNVEVDTAPTVDLNQVLNETRN,   SEQ ID NO:4918
LRCQLGDRLNVEVDAAPTVDLNRVLNETRN,   SEQ ID NO:4919
LRSQLGDRLNVEVDAAPTVDLNRVLNETRN,   SEQ ID NO:4920
LRCPLGDRLNVEVDAAPTVDLNRVLNETRN,   SEQ ID NO:4921
LRSPLGDRLNVEVDAAPTVDLNRVLNETRN,   SEQ ID NO:4922
LRCQLGDRLNVEVDTAPTVDLNRVLNETRN,   SEQ ID NO:4923
LRSQLGDRLNVEVDTAPTVDLNRVLNETRN,   SEQ ID NO:4924
LRCPLGDRLNVEVDTAPTVDLNRVLNETRN,   SEQ ID NO:4925
LRSPLGDRLNVEVDTAPTVDLNRVLNETRN,   SEQ ID NO:4926
RCQLGDRLNVEVDAAPTVDLNQVLNETRSQ,   SEQ ID NO:4927
RSQLGDRLNVEVDAAPTVDLNQVLNETRSQ,   SEQ ID NO:4928
RCPLGDRLNVEVDAAPTVDLNQVLNETRSQ,   SEQ ID NO:4929
RSPLGDRLNVEVDAAPTVDLNQVLNETRSQ,   SEQ ID NO:4930
RCQLGDRLNVEVDTAPTVDLNQVLNETRSQ,   SEQ ID NO:4931
RSQLGDRLNVEVDTAPTVDLNQVLNETRSQ,   SEQ ID NO:4932
RCPLGDRLNVEVDTAPTVDLNQVLNETRSQ,   SEQ ID NO:4933
RSPLGDRLNVEVDTAPTVDLNQVLNETRSQ,   SEQ ID NO:4934
RCQLGDRLNVEVDAAPTVDLNRVLNETRSQ,   SEQ ID NO:4935
RSQLGDRLNVEVDAAPTVDLNRVLNETRSQ,   SEQ ID NO:4936
RCPLGDRLNVEVDAAPTVDLNRVLNETRSQ,   SEQ ID NO:4937
RSPLGDRLNVEVDAAPTVDLNRVLNETRSQ,   SEQ ID NO:4938
RCQLGDRLNVEVDTAPTVDLNRVLNETRSQ,   SEQ ID NO:4939
RSQLGDRLNVEVDTAPTVDLNRVLNETRSQ,   SEQ ID NO:4940
RCPLGDRLNVEVDTAPTVDLNRVLNETRSQ,   SEQ ID NO:4941
RSPLGDRLNVEVDTAPTVDLNRVLNETRSQ,   SEQ ID NO:4942
RCQLGDRLNVEVDAAPTVDLNQVLNETRNQ,   SEQ ID NO:4943
RSQLGDRLNVEVDAAPTVDLNQVLNETRNQ,   SEQ ID NO:4944
RCPLGDRLNVEVDAAPTVDLNQVLNETRNQ,   SEQ ID NO:4945
RSPLGDRLNVEVDAAPTVDLNQVLNETRNQ,   SEQ ID NO:4946
RCQLGDRLNVEVDTAPTVDLNQVLNETRNQ,   SEQ ID NO:4947
RSQLGDRLNVEVDTAPTVDLNQVLNETRNQ,   SEQ ID NO:4948
RCPLGDRLNVEVDTAPTVDLNQVLNETRNQ,   SEQ ID NO:4949
RSPLGDRLNVEVDTAPTVDLNQVLNETRNQ,   SEQ ID NO:4950
RCQLGDRLNVEVDAAPTVDLNRVLNETRNQ,   SEQ ID NO:4951
RSQLGDRLNVEVDAAPTVDLNRVLNETRNQ,   SEQ ID NO:4952
RCPLGDRLNVEVDAAPTVDLNRVLNETRNQ,   SEQ ID NO:4953
RSPLGDRLNVEVDAAPTVDLNRVLNETRNQ,   SEQ ID NO:4954
RCQLGDRLNVEVDTAPTVDLNRVLNETRNQ,   SEQ ID NO:4955
RSQLGDRLNVEVDTAPTVDLNRVLNETRNQ,   SEQ ID NO:4956
RCPLGDRLNVEVDTAPTVDLNRVLNETRNQ,   SEQ ID NO:4957
RSPLGDRLNVEVDTAPTVDLNRVLNETRNQ,   SEQ ID NO:4958
CQLGDRLNVEVDAAPTVDLNQVLNETRSQY,   SEQ ID NO:4959
SQLGDRLNVEVDAAPTVDLNQVLNETRSQY,   SEQ ID NO:4960
CPLGDRLNVEVDAAPTVDLNQVLNETRSQY,   SEQ ID NO:4961
SPLGDRLNVEVDAAPTVDLNQVLNETRSQY,   SEQ ID NO:4962
CQLGDRLNVEVDTAPTVDLNQVLNETRSQY,   SEQ ID NO:4963
SQLGDRLNVEVDTAPTVDLNQVLNETRSQY,   SEQ ID NO:4964
CPLGDRLNVEVDTAPTVDLNQVLNETRSQY,   SEQ ID NO:4965
SPLGDRLNVEVDTAPTVDLNQVLNETRSQY,   SEQ ID NO:4966
CQLGDRLNVEVDAAPTVDLNRVLNETRSQY,   SEQ ID NO:4967
SQLGDRLNVEVDAAPTVDLNRVLNETRSQY,   SEQ ID NO:4968
CPLGDRLNVEVDAAPTVDLNRVLNETRSQY,   SEQ ID NO:4969
SPLGDRLNVEVDAAPTVDLNRVLNETRSQY,   SEQ ID NO:4970
CQLGDRLNVEVDTAPTVDLNRVLNETRSQY,   SEQ ID NO:4971
```

-continued

```
SQLGDRLNVEVDTAPTVDLNRVLNETRSQY,    SEQ ID NO:4972
CPLGDRLNVEVDTAPTVDLNRVLNETRSQY,    SEQ ID NO:4973
SPLGDRLNVEVDTAPTVDLNRVLNETRSQY,    SEQ ID NO:4974
CQLGDRLNVEVDAAPTVDLNQVLNETRNQY,    SEQ ID NO:4975
SQLGDRLNVEVDAAPTVDLNQVLNETRNQY,    SEQ ID NO:4976
CPLGDRLNVEVDAAPTVDLNQVLNETRNQY,    SEQ ID NO:4977
SPLGDRLNVEVDAAPTVDLNQVLNETRNQY,    SEQ ID NO:4978
CQLGDRLNVEVDTAPTVDLNQVLNETRNQY,    SEQ ID NO:4979
SQLGDRLNVEVDTAPTVDLNQVLNETRNQY,    SEQ ID NO:4980
CPLGDRLNVEVDTAPTVDLNQVLNETRNQY,    SEQ ID NO:4981
SPLGDRLNVEVDTAPTVDLNQVLNETRNQY,    SEQ ID NO:4982
CQLGDRLNVEVDAAPTVDLNRVLNETRNQY,    SEQ ID NO:4983
SQLGDRLNVEVDAAPTVDLNRVLNETRNQY,    SEQ ID NO:4984
CPLGDRLNVEVDAAPTVDLNRVLNETRNQY,    SEQ ID NO:4985
SPLGDRLNVEVDAAPTVDLNRVLNETRNQY,    SEQ ID NO:4986
CQLGDRLNVEVDTAPTVDLNRVLNETRNQY,    SEQ ID NO:4987
SQLGDRLNVEVDTAPTVDLNRVLNETRNQY,    SEQ ID NO:4988
CPLGDRLNVEVDTAPTVDLNRVLNETRNQY,    SEQ ID NO:4989
SPLGDRLNVEVDTAPTVDLNRVLNETRNQY,    SEQ ID NO:4990
QLGDRLNVEVDAAPTVDLNQVLNETRSQYE,    SEQ ID NO:4991
PLGDRLNVEVDAAPTVDLNQVLNETRSQYE,    SEQ ID NO:4992
QLGDRLNVEVDTAPTVDLNQVLNETRSQYE,    SEQ ID NO:4993
PLGDRLNVEVDTAPTVDLNQVLNETRSQYE,    SEQ ID NO:4994
QLGDRLNVEVDAAPTVDLNRVLNETRSQYE,    SEQ ID NO:4995
PLGDRLNVEVDAAPTVDLNRVLNETRSQYE,    SEQ ID NO:4996
QLGDRLNVEVDTAPTVDLNRVLNETRSQYE,    SEQ ID NO:4997
PLGDRLNVEVDTAPTVDLNRVLNETRSQYE,    SEQ ID NO:4998
QLGDRLNVEVDAAPTVDLNQVLNETRNQYE,    SEQ ID NO:4999
PLGDRLNVEVDAAPTVDLNQVLNETRNQYE,    SEQ ID NO:5000
QLGDRLNVEVDTAPTVDLNQVLNETRNQYE,    SEQ ID NO:5001
PLGDRLNVEVDTAPTVDLNQVLNETRNQYE,    SEQ ID NO:5002
QLGDRLNVEVDAAPTVDLNRVLNETRNQYE,    SEQ ID NO:5003
PLGDRLNVEVDAAPTVDLNRVLNETRNQYE,    SEQ ID NO:5004
QLGDRLNVEVDTAPTVDLNRVLNETRNQYE,    SEQ ID NO:5005
PLGDRLNVEVDTAPTVDLNRVLNETRNQYE,    SEQ ID NO:5006
LGDRLNVEVDAAPTVDLNQVLNETRSQYEA,    SEQ ID NO:5007
LGDRLNVEVDTAPTVDLNQVLNETRSQYEA,    SEQ ID NO:5008
LGDRLNVEVDAAPTVDLNRVLNETRSQYEA,    SEQ ID NO:5009
LGDRLNVEVDTAPTVDLNRVLNETRSQYEA,    SEQ ID NO:5010
LGDRLNVEVDAAPTVDLNQVLNETRNQYEA,    SEQ ID NO:5011
LGDRLNVEVDTAPTVDLNQVLNETRNQYEA,    SEQ ID NO:5012
LGDRLNVEVDAAPTVDLNRVLNETRNQYEA,    SEQ ID NO:5013
LGDRLNVEVDTAPTVDLNRVLNETRNQYEA,    SEQ ID NO:5014
GDRLNVEVDAAPTVDLNQVLNETRSQYEAL,    SEQ ID NO:5015
GDRLNVEVDTAPTVDLNQVLNETRSQYEAL,    SEQ ID NO:5016
GDRLNVEVDAAPTVDLNRVLNETRSQYEAL,    SEQ ID NO:5017
GDRLNVEVDTAPTVDLNRVLNETRSQYEAL,    SEQ ID NO:5018
GDRLNVEVDAAPTVDLNQVLNETRNQYEAL,    SEQ ID NO:5019
GDRLNVEVDTAPTVDLNQVLNETRNQYEAL,    SEQ ID NO:5020
GDRLNVEVDAAPTVDLNRVLNETRNQYEAL,    SEQ ID NO:5021
GDRLNVEVDTAPTVDLNRVLNETRNQYEAL,    SEQ ID NO:5022
EVNTLRCQLGDRLNVEVDAAPTVDLNQVLNE,   SEQ ID NO:5023
EVNTLRSQLGDRLNVEVDAAPTVDLNQVLNE,   SEQ ID NO:5024
EVNTLRCPLGDRLNVEVDAAPTVDLNQVLNE,   SEQ ID NO:5025
EVNTLRSPLGDRLNVEVDAAPTVDLNQVLNE,   SEQ ID NO:5026
EVNTLRCQLGDRLNVEVDTAPTVDLNQVLNE,   SEQ ID NO:5027
EVNTLRSQLGDRLNVEVDTAPTVDLNQVLNE,   SEQ ID NO:5028
EVNTLRCPLGDRLNVEVDTAPTVDLNQVLNE,   SEQ ID NO:5029
EVNTLRSPLGDRLNVEVDTAPTVDLNQVLNE,   SEQ ID NO:5030
EVNTLRCQLGDRLNVEVDAAPTVDLNRVLNE,   SEQ ID NO:5031
EVNTLRSQLGDRLNVEVDAAPTVDLNRVLNE,   SEQ ID NO:5032
EVNTLRCPLGDRLNVEVDAAPTVDLNRVLNE,   SEQ ID NO:5033
EVNTLRSPLGDRLNVEVDAAPTVDLNRVLNE,   SEQ ID NO:5034
EVNTLRCQLGDRLNVEVDTAPTVDLNRVLNE,   SEQ ID NO:5035
EVNTLRSQLGDRLNVEVDTAPTVDLNRVLNE,   SEQ ID NO:5036
EVNTLRCPLGDRLNVEVDTAPTVDLNRVLNE,   SEQ ID NO:5037
EVNTLRSPLGDRLNVEVDTAPTVDLNRVLNE,   SEQ ID NO:5038
VNTLRCQLGDRLNVEVDAAPTVDLNQVLNET,   SEQ ID NO:5039
VNTLRSQLGDRLNVEVDAAPTVDLNQVLNET,   SEQ ID NO:5040
VNTLRCPLGDRLNVEVDAAPTVDLNQVLNET,   SEQ ID NO:5041
NTLRSPLGDRLNVEVDAAPTVDLNQVLNET,    SEQ ID NO:5042
VNTLRCQLGDRLNVEVDTAPTVDLNQVLNET,   SEQ ID NO:5043
VNTLRSQLGDRLNVEVDTAPTVDLNQVLNET,   SEQ ID NO:5044
VNTLRCPLGDRLNVEVDTAPTVDLNQVLNET,   SEQ ID NO:5045
VNTLRSPLGDRLNVEVDTAPTVDLNQVLNET,   SEQ ID NO:5046
VNTLRCQLGDRLNVEVDAAPTVDLNRVLNET,   SEQ ID NO:5047
VNTLRSQLGDRLNVEVDAAPTVDLNRVLNET,   SEQ ID NO:5048
VNTLRCPLGDRLNVEVDAAPTVDLNRVLNET,   SEQ ID NO:5049
VNTLRSPLGDRLNVEVDAAPTVDLNRVLNET,   SEQ ID NO:5050
VNTLRCQLGDRLNVEVDTAPTVDLNRVLNET,   SEQ ID NO:5051
```

-continued

```
VNTLRSQLGDRLNVEVDTAPTVDLNRVLNET,   SEQ ID NO:5052
VNTLRCPLGDRLNVEVDTAPTVDLNRVLNET,   SEQ ID NO:5053
VNTLRSPLGDRLNVEVDTAPTVDLNRVLNET,   SEQ ID NO:5054
NTLRCQLGDRLNVEVDAAPTVDLNQVLNETR,   SEQ ID NO:5055
NTLRSQLGDRLNVEVDAAPTVDLNQVLNETR,   SEQ ID NO:5056
NTLRCPLGDRLNVEVDAAPTVDLNQVLNETR,   SEQ ID NO:5057
NTLRSPLGDRLNVEVDAAPTVDLNQVLNETR,   SEQ ID NO:5058
NTLRCQLGDRLNVEVDTAPTVDLNQVLNETR,   SEQ ID NO:5059
NTLRSQLGDRLNVEVDTAPTVDLNQVLNETR,   SEQ ID NO:5060
NTLRCPLGDRLNVEVDTAPTVDLNQVLNETR,   SEQ ID NO:5061
NTLRSPLGDRLNVEVDTAPTVDLNQVLNETR,   SEQ ID NO:5062
NTLRCQLGDRLNVEVDAAPTVDLNRVLNETR,   SEQ ID NO:5063
NTLRSQLGDRLNVEVDAAPTVDLNRVLNETR,   SEQ ID NO:5064.
NTLRCPLGDRLNVEVDAAPTVDLNRVLNETR,   SEQ ID NO:5065
NTLRSPLGDRLNVEVDAAPTVDLNRVLNETR,   SEQ ID NO:5066
NTLRCQLGDRLNVEVDTAPTVDLNRVLNETR,   SEQ ID NO:5067
NTLRSQLGDRLNVEVDTAPTVDLNRVLNETR,   SEQ ID NO:5068
NTLRCPLGDRLNVEVDTAPTVDLNRVLNETR,   SEQ ID NO:5069
NTLRSPLGDRLNVEVDTAPTVDLNRVLNETR,   SEQ ID NO:5070
TLRCQLGDRLNVEVDAAPTVDLNQVLNETRS,   SEQ ID NO:5071
TLRSQLGDRLNVEVDAAPTVDLNQVLNETRS,   SEQ ID NO:5072
TLRCPLGDRLNVEVDAAPTVDLNQVLNETRS,   SEQ ID NO:5073
TLRSPLGDRLNVEVDAAPTVDLNQVLNETRS,   SEQ ID NO:5074
TLRCQLGDRLNVEVDTAPTVDLNQVLNETRS,   SEQ ID NO:5075
TLRSQLGDRLNVEVDTAPTVDLNQVLNETRS,   SEQ ID NO:5076
TLRCPLGDRLNVEVDTAPTVDLNQVLNETRS,   SEQ ID NO:5077
TLRSPLGDRLNVEVDTAPTVDLNQVLNETRS,   SEQ ID NO:5078
TLRCQLGDRLNVEVDAAPTVDLNRVLNETRS,   SEQ ID NO:5079
TLRSQLGDRLNVEVDAAPTVDLNRVLNETRS,   SEQ ID NO:5080
TLRCPLGDRLNVEVDAAPTVDLNRVLNETRS,   SEQ ID NO:5081
TLRSPLGDRLNVEVDAAPTVDLNRVLNETRS,   SEQ ID NO:5082
TLRCQLGDRLNVEVDTAPTVDLNRVLNETRS,   SEQ ID NO:5083
TLRSQLGDRLNVEVDTAPTVDLNRVLNETRS,   SEQ ID NO:5084
TLRCPLGDRLNVEVDTAPTVDLNRVLNETRS,   SEQ ID NO:5085
TLRSPLGDRLNVEVDTAPTVDLNRVLNETRS,   SEQ ID NO:5086
TLRCQLGDRLNVEVDAAPTVDLNQVLNETRN,   SEQ ID NO:5087
TLRSQLGDRLNVEVDAAPTVDLNQVLNETRN,   SEQ ID NO:5088
TLRCPLGDRLNVEVDAAPTVDLNQVLNETRN,   SEQ ID NO:5089
TLRSPLGDRLNVEVDAAPTVDLNQVLNETRN,   SEQ ID NO:5090
TLRCQLGDRLNVEVDTAPTVDLNQVLNETRN,   SEQ ID NO:5091
TLRSQLGDRLNVEVDTAPTVDLNQVLNETRN,   SEQ ID NO:5092
TLRCPLGDRLNVEVDTAPTVDLNQVLNETRN,   SEQ ID NO:5093
TLRSPLGDRLNVEVDTAPTVDLNQVLNETRN,   SEQ ID NO:5094
TLRCQLGDRLNVEVDAAPTVDLNRVLNETRN,   SEQ ID NO:5095
TLRSQLGDRLNVEVDAAPTVDLNRVLNETRN,   SEQ ID NO:5096
TLRCPLGDRLNVEVDAAPTVDLNRVLNETRN,   SEQ ID NO:5097
TLRSPLGDRLNVEVDAAPTVDLNRVLNETRN,   SEQ ID NO:5098
TLRCQLGDRLNVEVDTAPTVDLNRVLNETRN,   SEQ ID NO:5099
TLRSQLGDRLNVEVDTAPTVDLNRVLNETRN,   SEQ ID NO:5100
TLRCPLGDRLNVEVDTAPTVDLNRVLNETRN,   SEQ ID NO:5101
TLRSPLGDRLNVEVDTAPTVDLNRVLNETRN,   SEQ ID NO:5102
LRCQLGDRLNVEVDAAPTVDLNQVLNETRSQ,   SEQ ID NO:5103
LRSQLGDRLNVEVDAAPTVDLNQVLNETRSQ,   SEQ ID NO:5104
LRCPLGDRLNVEVDAAPTVDLNQVLNETRSQ,   SEQ ID NO:5105
LRSPLGDRLNVEVDAAPTVDLNQVLNETRSQ,   SEQ ID NO:5106
LRCQLGDRLNVEVDTAPTVDLNQVLNETRSQ,   SEQ ID NO:5107
LRSQLGDRLNVEVDTAPTVDLNQVLNETRSQ,   SEQ ID NO:5108
LRCPLGDRLNVEVDTAPTVDLNQVLNETRSQ,   SEQ ID NO:5109
LRSPLGDRLNVEVDTAPTVDLNQVLNETRSQ,   SEQ ID NO:5110
LRCQLGDRLNVEVDAAPTVDLNRVLNETRSQ,   SEQ ID NO:5111
LRSQLGDRLNVEVDAAPTVDLNRVLNETRSQ,   SEQ ID NO:5112
LRCPLGDRLNVEVDAAPTVDLNRVLNETRSQ,   SEQ ID NO:5113
LRSPLGDRLNVEVDAAPTVDLNRVLNETRSQ,   SEQ ID NO:5114
LRCQLGDRLNVEVDTAPTVDLNRVLNETRSQ,   SEQ ID NO:5115
LRSQLGDRLNVEVDTAPTVDLNRVLNETRSQ,   SEQ ID NO:5116
LRCPLGDRLNVEVDTAPTVDLNRVLNETRSQ,   SEQ ID NO:5117
LRSPLGDRLNVEVDTAPTVDLNRVLNETRSQ,   SEQ ID NO:5118
LRCQLGDRLNVEVDAAPTVDLNQVLNETRNQ,   SEQ ID NO:5119
LRSQLGDRLNVEVDAAPTVDLNQVLNETRNQ,   SEQ ID NO:5120
LRCPLGDRLNVEVDAAPTVDLNQVLNETRNQ,   SEQ ID NO:5121
LRSPLGDRLNVEVDAAPTVDLNQVLNETRNQ,   SEQ ID NO:5122
LRCQLGDRLNVEVDTAPTVDLNQVLNETRNQ,   SEQ ID NO:5123
LRSQLGDRLNVEVDTAPTVDLNQVLNETRNQ,   SEQ ID NO:5124
LRCPLGDRLNVEVDTAPTVDLNQVLNETRNQ,   SEQ ID NO:5125
LRSPLGDRLNVEVDTAPTVDLNQVLNETRNQ,   SEQ ID NO:5126
LRCQLGDRLNVEVDAAPTVDLNRVLNETRNQ,   SEQ ID NO:5127
LRSQLGDRLNVEVDAAPTVDLNRVLNETRNQ,   SEQ ID NO:5128
LRCPLGDRLNVEVDAAPTVDLNRVLNETRNQ,   SEQ ID NO:5129
LRSPLGDRLNVEVDAAPTVDLNRVLNETRNQ,   SEQ ID NO:5130
LRCQLGDRLNVEVDTAPTVDLNRVLNETRNQ,   SEQ ID NO:5131
```

```
                                        -continued
LRSQLGDRLNVEVDTAPTVDLNRVLNETRNQ,        SEQ ID NO:5132
LRCPLGDRLNVEVDTAPTVDLNRVLNETRNQ,        SEQ ID NO:5133
LRSPLGDRLNVEVDTAPTVDLNRVLNETRNQ,        SEQ ID NO:5134
RCQLGDRLNYEVDAAPTVDLNQVLNETRSQY,        SEQ ID NO:5135
RSQLGDRLNVEVDAAPTVDLNQVLNETRSQY,        SEQ ID NO:5136
RCPLGDRLNVEVDAAPTVDLNQVLNETRSQY,        SEQ ID NO:5137
RSPLGDRLNVEVDAAPTVDLNQVLNETRSQY,        SEQ ID NO:5138
RCQLGDRLNVEVDTAPTVDLNQVLNETRSQY,        SEQ ID NO:5139
RSQLGDRLNVEVDTAPTVDLNQVLNETRSQY,        SEQ ID NO:5140
RCPLGDRLNVEVDTAPTVDLNQVLNETRSQY,        SEQ ID NO:5141
RSPLGDRLNVEVDTAPTVDLNQVLNETRSQY,        SEQ ID NO:5142
RCQLGDRLNVEVDAAPTVDLNRVLNETRSQY,        SEQ ID NO:5143
RSQLGDRLNVEVDAAPTVDLNRVLNETRSQY,        SEQ ID NO:5144
RCPLGDRLNVEVDAAPTVDLNRVLNETRSQY,        SEQ ID NO:5145
RSPLGDRLNVEVDAAPTVDLNRVLNETRSQY,        SEQ ID NO:5146
RCQLGDRLNVEVDTAPTVDLNRVLNETRSQY,        SEQ ID NO:5147
RSQLGDRLNVEVDTAPTVDLNRVLNETRSQY,        SEQ ID NO:5148
RCPLGDRLNVEVDTAPTVDLNRVLNETRSQY,        SEQ ID NO:5149
RSPLGDRLNVEVDTAPTVDLNRVLNETRSQY,        SEQ ID NO:5150
RCQLGDRLNVEVDAAPTVDLNQVLNETRNQY,        SEQ ID NO:5151
RSQLGDRLNVEVDAAPTVDLNQVLNETRNQY,        SEQ ID NO:5152
RCPLGDRLNVEVDAAPTVDLNQVLNETRNQY,        SEQ ID NO:5153
RSPLGDRLNVEVDAAPTVDLNQVLNETRNQY,        SEQ ID NO:5154
RCQLGDRLNVEVDTAPTVDLNQVLNETRNQY,        SEQ ID NO:5155
RSQLGDRLNVEVDTAPTVDLNQVLNETRNQY,        SEQ ID NO:5156
RCPLGDRLNVEVDTAPTVDLNQVLNETRNQY,        SEQ ID NO:5157
RSPLGDRLNVEVDTAPTVDLNQVLNETRNQY,        SEQ ID NO:5158
RCQLGDRLNVEVDAAPTVDLNRVLNETRNQY,        SEQ ID NO:5159
RSQLGDRLNVEVDAAPTVDLNRVLNETRNQY,        SEQ ID NO:5160
RCPLGDRLNVEVDAAPTVDLNRVLNETRNQY,        SEQ ID NO:5161
RSPLGDRLNVEVDAAPTVDLNRVLNETRNQY,        SEQ ID NO:5162
RCQLGDRLNVEVDTAPTVDLNRVLNETRNQY,        SEQ ID NO:5163
RSQLGDRLNVEVDTAPTVDLNRVLNETRNQY,        SEQ ID NO:5164
RCPLGDRLNVEVDTAPTVDLNRVLNETRNQY,        SEQ ID NO:5165
RSPLGDRLNVEVDTAPTVDLNRVLNETRNQY,        SEQ ID NO:5166
CQLGDRLNVEVDAAPTVDLNQVLNETRSQYE,        SEQ ID NO:5167
SQLGDRLNVEVDAAPTVDLNQVLNETRSQYE,        SEQ ID NO:5168
CPLGDRLNVEVDAAPTVDLNQVLNETRSQYE,        SEQ ID NO:5169
SPLGDRLNVEVDAAPTVDLNQVLNETRSQYE,        SEQ ID NO:5160
CQLGDRLNVEVDTAPTVDLNQVLNETRSQYE,        SEQ ID NO:5161
SQLGDRLNVEVDTAPTVDLNQVLNETRSQYE,        SEQ ID NO:5162
CPLGDRLNVEVDTAPTVDLNQVLNETRSQYE,        SEQ ID NO:5163
SPLGDRLNVEVDTAPTVDLNQVLNETRSQYE,        SEQ ID NO:5164
CQLGDRLNVEVDAAPTVDLNRVLNETRSQYE,        SEQ ID NO:5165
SQLGDRLNVEVDAAPTVDLNRVLNETRSQYE,        SEQ ID NO:5166
CPLGDRLNVEVDAAPTVDLNRVLNETRSQYE,        SEQ ID NO:5167
SPLGDRLNVEVDAAPTVDLNRVLNETRSQYE,        SEQ ID NO:5168
CQLGDRLNVEVDTAPTVDLNRVLNETRSQYE,        SEQ ID NO:5169
SQLGDRLNVEVDTAPTVDLNRVLNETRSQYE,        SEQ ID NO:5170
CPLGDRLNVEVDTAPTVDLNRVLNETRSQYE,        SEQ ID NO:5171
SPLGDRLNVEVDTAPTVDLNRVLNETRSQYE,        SEQ ID NO:5172
CQLGDRLNVEVDAAPTVDLNQVLNETRNQYE,        SEQ ID NO:5173
SQLGDRLNVEVDAAPTVDLNQVLNETRNQYE,        SEQ ID NO:5174
CPLGDRLNVEVDAAPTVDLNQVLNETRNQYE,        SEQ ID NO:5175
SPLGDRLNVEVDAAPTVDLNQVLNETRNQYE,        SEQ ID NO:5176
CQLGDRLNVEVDTAPTVDLNQVLNETRNQYE,        SEQ ID NO:5177
SQLGDRLNVEVDTAPTVDLNQVLNETRNQYE,        SEQ ID NO:5178
CPLGDRLNVEVDTAPTVDLNQVLNETRNQYE,        SEQ ID NO:5179
SPLGDRLNVEVDTAPTVDLNQVLNETRNQYE,        SEQ ID NO:5180
CQLGDRLNVEVDAAPTVDLNRVLNETRNQYE,        SEQ ID NO:5181
SQLGDRLNVEVDAAPTVDLNRVLNETRNQYE,        SEQ ID NO:5182
CPLGDRLNVEVDAAPTVDLNRVLNETRNQYE,        SEQ ID NO:5183
SPLGDRLNVEVDAAPTVDLNRVLNETRNQYE,        SEQ ID NO:5184
CQLGDRLNVEVDTAPTVDLNRVLNETRNQYE,        SEQ ID NO:5185
SQLGDRLNVEVDTAPTVDLNRVLNETRNQYE,        SEQ ID NO:5186
CPLGDRLNVEVDTAPTVDLNRVLNETRNQYE,        SEQ ID NO:5187
SPLGDRLNVEVDTAPTVDLNRVLNETRNQYE,        SEQ ID NO:5188
QLGDRLNVEVDAAPTVDLNQVLNETRSQYEA,        SEQ ID NO:5189
PLGDRLNVEVDAAPTVDLNQVLNETRSQYEA,        SEQ ID NO:5190
QLGDRLNVEVDTAPTVDLNQVLNETRSQYEA,        SEQ ID NO:5191
PLGDRLNVEVDTAPTVDLNQVLNETRSQYEA,        SEQ ID NO:5192
QLGDRLNVEVDAAPTVDLNRVLNETRSQYEA,        SEQ ID NO:5193
PLGDRLNVEVDAAPTVDLNRVLNETRSQYEA,        SEQ ID NO:5194
QLGDRLNVEVDTAPTVDLNRVLNETRSQYEA,        SEQ ID NO:5195
PLGDRLNVEVDTAPTVDLNRVLNETRSQYEA,        SEQ ID NO:5196
QLGDRLNVEVDAAPTVDLNQVLNETRNQYEA,        SEQ ID NO:5197
PLGDRLNVEVDAAPTVDLNQVLNETRNQYEA,        SEQ ID NO:5198
QLGDRLNVEVDTAPTVDLNQVLNETRNQYEA,        SEQ ID NO:5199
PLGDRLNVEVDTAPTVDLNQVLNETRNQYEA,        SEQ ID NO:5200
QLGDRLNVEVDAAPTVDLNRVLNETRNQYEA,        SEQ ID NO:5201
```

-continued

```
PLGDRLNVEVDAAPTVDLNRVLNETRNQYEA,   SEQ ID NO:5202
QLGDRLNVEVDTAPTVDLNRVLNETRNQYEA,   SEQ ID NO:5203
PLGDRLNVEVDTAPTVDLNRVLNETRNQYEA,   SEQ ID NO:5204
LGDRLNVEVDAAPTVDLNQVLNETRSQYEAL,   SEQ ID NO:5205
LGDRLNVEVDTAPTVDLNQVLNETRSQYEAL,   SEQ ID NO:5206
LGDRLNVEVDAAPTVDLNRVLNETRSQYEAL,   SEQ ID NO:5207
LGDRLNVEVDTAPTVDLNRVLNETRSQYEAL,   SEQ ID NO:5208
LGDRLNVEVDAAPTVDLNQVLNETRNQYEAL,   SEQ ID NO:5209
LGDRLNVEVDTAPTVDLNQVLNETRNQYEAL,   SEQ ID NO:5210
ELGDRLNVEVDAAPTVDLNRVLNETRNQYEAL,  SEQ ID NO:5211
LGDRLNVEVDTAPTVDLNRVLNETRNQYEAL,   SEQ ID NO:5212
EVNTLRCQLGDRLNVEVDAAPTVDLNQVLNET,  SEQ ID NO:5213
EVNTLRSQLGDRLNVEVDAAPTVDLNQVLNET,  SEQ ID NO:5214
EVNTLRCPLGDRLNVEVDAAPTVDLNQVLNET,  SEQ ID NO:5215
EVNTLRSPLGDRLNVEVDAAPTVDLNQVLNET,  SEQ ID NO:5216
EVNTLRCQLGDRLNVEVDTAPTVDLNQVLNET,  SEQ ID NO:5217
EVNTLRSQLGDRLNVEVDTAPTVDLNQVLNET,  SEQ ID NO:5218
EVNTLRCPLGDRLNVEVDTAPTVDLNQVLNET,  SEQ ID NO:5219
EVNTLRSPLGDRLNVEVDTAPTVDLNQVLNET,  SEQ ID NO:5220
EVNTLRCQLGDRLNVEVDAAPTVDLNRVLNET,  SEQ ID NO:5221
EVNTLRSQLGDRLNVEVDAAPTVDLNRVLNET,  SEQ ID NO:5222
EVNTLRCPLGDRLNVEVDAAPTVDLNRVLNET,  SEQ ID NO:5223
EVNTLRSPLGDRLNVEVDAAPTVDLNRVLNET,  SEQ ID NO:5224
EVNTLRCQLGDRLNVEVDTAPTVDLNRVLNET,  SEQ ID NO:5225
EVNTLRSQLGDRLNVEVDTAPTVDLNRVLNET,  SEQ ID NO:5226
EVNTLRCPLGDRLNVEVDTAPTVDLNRVLNET,  SEQ ID NO:5227
EVNTLRSPLGDRLNVEVDTAPTVDLNRVLNET,  SEQ ID NO:5228
VNTLRCQLGDRLNVEVDAAPTVDLNQVLNETR,  SEQ ID NO:5229
VNTLRSQLGDRLNVEVDAAPTVDLNQVLNETR,  SEQ ID NO:5230
VNTLRCPLGDRLNVEVDAAPTVDLNQVLNETR,  SEQ ID NO:5231
VNTLRSPLGDRLNVEVDAAPTVDLNQVLNETR,  SEQ ID NO:5232
VNTLRCQLGDRLNVEVDTAPTVDLNQVLNETR,  SEQ ID NO:5233
VNTLRSQLGDRLNVEVDTAPTVDLNQVLNETR,  SEQ ID NO:5234
VNTLRCPLGDRLNVEVDTAPTVDLNQVLNETR,  SEQ ID NO:5235
VNTLRSPLGDRLNVEVDTAPTVDLNQVLNETR,  SEQ ID NO:5236
VNTLRCQLGDRLNVEVDAAPTVDLNRVLNETR,  SEQ ID NO:5237
VNTLRSQLGDRLNVEVDAAPTVDLNRVLNETR,  SEQ ID NO:5238
VNTLRCPLGDRLNVEVDAAPTVDLNRVLNETR,  SEQ ID NO:5239
VNTLRSPLGDRLNVEVDAAPTVDLNRVLNETR,  SEQ ID NO:5240
VNTLRCQLGDRLNVEVDTAPTVDLNRVLNETR,  SEQ ID NO:5241
VNTLRSQLGDRLNVEVDTAPTVDLNRVLNETR,  SEQ ID NO:5242
VNTLRCPLGDRLNVEVDTAPTVDLNRVLNETR,  SEQ ID NO:5243
VNTLRSPLGDRLNVEVDTAPTVDLNRVLNETR,  SEQ ID NO:5244
NTLRCQLGDRLNVEVDAAPTVDLNQVLNETRS,  SEQ ID NO:5245
NTLRSQLGDRLNVEVDAAPTVDLNQVLNETRS,  SEQ ID NO:5246
NTLRCPLGDRLNVEVDAAPTVDLNQVLNETRS,  SEQ ID NO:5247
NTLRSPLGDRLNVEVDAAPTVDLNQVLNETRS,  SEQ ID NO:5248
NTLRCQLGDRLNVEVDTAPTVDLNQVLNETRS,  SEQ ID NO:5249
NTLRSQLGDRLNVEVDTAPTVDLNQVLNETRS,  SEQ ID NO:5250
NTLRCPLGDRLNVEVDTAPTVDLNQVLNETRS,  SEQ ID NO:5251
NTLRSPLGDRLNVEVDTAPTVDLNQVLNETRS,  SEQ ID NO:5252
NTLRCQLGDRLNVEVDAAPTVDLNRVLNETRS,  SEQ ID NO:5253
NTLRSQLGDRLNVEVDAAPTVDLNRVLNETRS,  SEQ ID NO:5254
NTLRCPLGDRLNVEVDAAPTVDLNRVLNETRS,  SEQ ID NO:5255
NTLRSPLGDRLNVEVDAAPTVDLNRVLNETRS,  SEQ ID NO:5256
NTLRCQLGDRLNVEVDTAPTVDLNRVLNETRS,  SEQ ID NO:5257
NTLRSQLGDRLNVEVDTAPTVDLNRVLNETRS,  SEQ ID NO:5258
NTLRCPLGDRLNVEVDTAPTVDLNRVLNETRS,  SEQ ID NO:5259
NTLRSPLGDRLNVEVDTAPTVDLNRVLNETRS,  SEQ ID NO:5260
NTLRCQLGDRLNVEVDAAPTVDLNQVLNETRN,  SEQ ID NO:5261
NTLRSQLGDRLNVEVDAAPTVDLNQVLNETRN,  SEQ ID NO:5262
NTLRCPLGDRLNVEVDAAPTVDLNQVLNETRN,  SEQ ID NO:5263
NTLRSPLGDRLNVEVDAAPTVDLNQVLNETRN,  SEQ ID NO:5264
NTLRCQLGDRLNVEVDTAPTVDLNQVLNETRN,  SEQ ID NO:5265
NTLRSQLGDRLNVEVDTAPTVDLNQVLNETRN,  SEQ ID NO:5266
NTLRCPLGDRLNVEVDTAPTVDLNQVLNETRN,  SEQ ID NO:5267
NTLRSPLGDRLNVEVDTAPTVDLNQVLNETRN,  SEQ ID NO:5268
NTLRCQLGDRLNVEVDAAPTVDLNRVLNETRN,  SEQ ID NO:5269
NTLRSQLGDRLNVEVDAAPTVDLNRVLNETRN,  SEQ ID NO:5270
NTLRCPLGDRLNVEVDAAPTVDLNRVLNETRN,  SEQ ID NO:5271
NTLRSPLGDRLNVEVDAAPTVDLNRVLNETRN,  SEQ ID NO:5272
NTLRCQLGDRLNVEVDTAPTVDLNRVLNETRN,  SEQ ID NO:5273
NTLRSQLGDRLNVEVDTAPTVDLNRVLNETRN,  SEQ ID NO:5274
NTLRCPLGDRLNVEVDTAPTVDLNRVLNETRN,  SEQ ID NO:5275
NTLRSPLGDRLNVEVDTAPTVDLNRVLNETRN,  SEQ ID NO:5276
TLRCQLGDRLNVEVDAAPTVDLNQVLNETRSQ,  SEQ ID NO:5277
TLRSQLGDRLNVEVDAAPTVDLNQVLNETRSQ,  SEQ ID NO:5278
TLRCPLGDRLNVEVDAAPTVDLNQVLNETRSQ,  SEQ ID NO:5279
TLRSPLGDRLNVEVDAAPTVDLNQVLNETRSQ,  SEQ ID NO:5280
TLRCQLGDRLNVEVDTAPTVDLNQVLNETRSQ,  SEQ ID NO:5281
```

```
                                        -continued
TLRSQLGDRLNVEVDTAPTVDLNQVLNETRSQ,  SEQ ID NO:5282
TLRCPLGDRLNVEVDTAPTVDLNQVLNETRSQ,  SEQ ID NO:5283
TLRSPLGDRLNVEVDTAPTVDLNQVLNETRSQ,  SEQ ID NO:5284
TLRCQLGDRLNVEVDAAPTVDLNRVLNETRSQ,  SEQ ID NO:5285
TLRSQLGDRLNVEVDAAPTVDLNRVLNETRSQ,  SEQ ID NO:5286
TLRCPLGDRLNVEVDAAPTVDLNRVLNETRSQ,  SEQ ID NO:5287
TLRSPLGDRLNVEVDAAPTVDLNRVLNETRSQ,  SEQ ID NO:5288
TLRCQLGDRLNVEVDTAPTVDLNRVLNETRSQ,  SEQ ID NO:5289
TLRSQLGDRLNVEVDTAPTVDLNRVLNETRSQ,  SEQ ID NO:5290
TLRCPLGDRLNVEVDTAPTVDLNRVLNETRSQ,  SEQ ID NO:5291
TLRSPLGDRLNVEVDTAPTVDLNRVLNETRSQ,  SEQ ID NO:5292
TLRCQLGDRLNVEVDAAPTVDLNQVLNETRNQ,  SEQ ID NO:5293
TLRSQLGDRLNVEVDAAPTVDLNQVLNETRNQ,  SEQ ID NO:5294
TLRCPLGDRLNVEVDAAPTVDLNQVLNETRNQ,  SEQ ID NO:5295
TLRSPLGDRLNVEVDAAPTVDLNQVLNETRNQ,  SEQ ID NO:5296
TLRCQLGDRLNVEVDTAPTVDLNQVLNETRNQ,  SEQ ID NO:5297
TLRSQLGDRLNVEVDTAPTVDLNQVLNETRNQ,  SEQ ID NO:5298
TLRCPLGDRLNVEVDTAPTVDLNQVLNETRNQ,  SEQ ID NO:5299
TLRSPLGDRLNVEVDTAPTVDLNQVLNETRNQ,  SEQ ID NO:5300
TLRCQLGDRLNVEVDAAPTVDLNRVLNETRNQ,  SEQ ID NO:5301
TLRSQLGDRLNVEVDAAPTVDLNRVLNETRNQ,  SEQ ID NO:5302
TLRCPLGDRLNVEVDAAPTVDLNRVLNETRNQ,  SEQ ID NO:5303
TLRSPLGDRLNVEVDAAPTVDLNRVLNETRNQ,  SEQ ID NO:5304
TLRCQLGDRLNVEVDTAPTVDLNRVLNETRNQ,  SEQ ID NO:5305
TLRSQLGDRLNVEVDTAPTVDLNRVLNETRNQ,  SEQ ID NO:5306
TLRCPLGDRLNVEVDTAPTVDLNRVLNETRNQ,  SEQ ID NO:5307
TLRSPLGDRLNVEVDTAPTVDLNRVLNETRNQ,  SEQ ID NO:5308
LRCQLGDRLNVEVDAAPTVDLNQVLNETRSQY,  SEQ ID NO:5309
LRSQLGDRLNVEVDAAPTVDLNQVLNETRSQY,  SEQ ID NO:5310
LRCPLGDRLNVEVDAAPTVDLNQVLNETRSQY,  SEQ ID NO:5311
LRSPLGDRLNVEVDAAPTVDLNQVLNETRSQY,  SEQ ID NO:5312
LRCQLGDRLNVEVDTAPTVDLNQVLNETRSQY,  SEQ ID NO:5313
LRSQLGDRLNVEVDTAPTVDLNQVLNETRSQY,  SEQ ID NO:5314
LRCPLGDRLNVEVDTAPTVDLNQVLNETRSQY,  SEQ ID NO:5315
LRSPLGDRLNVEVDTAPTVDLNQVLNETRSQY,  SEQ ID NO:5316
LRCQLGDRLNVEVDAAPTVDLNRVLNETRSQY,  SEQ ID NO:5317
LRSQLGDRLNVEVDAAPTVDLNRVLNETRSQY,  SEQ ID NO:5318
LRCPLGDRLNVEVDAAPTVDLNRVLNETRSQY,  SEQ ID NO:5319
LRSPLGDRLNVEVDAAPTVDLNRVLNETRSQY,  SEQ ID NO:5320
LRCQLGDRLNVEVDTAPTVDLNRVLNETRSQY,  SEQ ID NO:5321
LRSQLGDRLNVEVDTAPTVDLNRVLNETRSQY,  SEQ ID NO:5322
LRCPLGDRLNVEVDTAPTVDLNRVLNETRSQY,  SEQ ID NO:5323
LRSPLGDRLNVEVDTAPTVDLNRVLNETRSQY,  SEQ ID NO:5324
LRCQLGDRLNVEVDAAPTVDLNQVLNETRNQY,  SEQ ID NO:5325
LRSQLGDRLNVEVDAAPTVDLNQVLNETRNQY,  SEQ ID NO:5326
LRCPLGDRLNVEVDAAPTVDLNQVLNETRNQY,  SEQ ID NO:5327
LRSPLGDRLNVEVDAAPTVDLNQVLNETRNQY,  SEQ ID NO:5328
LRCQLGDRLNVEVDTAPTVDLNQVLNETRNQY,  SEQ ID NO:5329
LRSQLGDRLNVEVDTAPTVDLNQVLNETRNQY,  SEQ ID NO:5330
LRCPLGDRLNVEVDTAPTVDLNQVLNETRNQY,  SEQ ID NO:5331
LRSPLGDRLNVEVDTAPTVDLNQVLNETRNQY,  SEQ ID NO:5332
LRCQLGDRLNVEVDAAPTVDLNRVLNETRNQY,  SEQ ID NO:5333
LRSQLGDRLNVEVDAAPTVDLNRVLNETRNQY,  SEQ ID NO:5334
LRCPLGDRLNVEVDAAPTVDLNRVLNETRNQY,  SEQ ID NO:5335
LRSPLGDRLNVEVDAAPTVDLNRVLNETRNQY,  SEQ ID NO:5336
LRCQLGDRLNVEVDTAPTVDLNRVLNETRNQY,  SEQ ID NO:5337
LRSQLGDRLNVEVDTAPTVDLNRVLNETRNQY,  SEQ ID NO:5338
LRCPLGDRLNVEVDTAPTVDLNRVLNETRNQY,  SEQ ID NO:5339
LRSPLGDRLNVEVDTAPTVDLNRVLNETRNQY,  SEQ ID NO:5340
RCQLGDRLNVEVDAAPTVDLNQVLNETRSQYE,  SEQ ID NO:5341
RSQLGDRLNVEVDAAPTVDLNQVLNETRSQYE,  SEQ ID NO:5342
RCPLGDRLNVEVDAAPTVDLNQVLNETRSQYE,  SEQ ID NO:5343
RSPLGDRLNVEVDAAPTVDLNQVLNETRSQYE,  SEQ ID NO:5344
RCQLGDRLNVEVDTAPTVDLNQVLNETRSQYE,  SEQ ID NO:5345
RSQLGDRLNVEVDTAPTVDLNQVLNETRSQYE,  SEQ ID NO:5346
RCPLGDRLNVEVDTAPTVDLNQVLNETRSQYE,  SEQ ID NO:5347
RSPLGDRLNVEVDTAPTVDLNQVLNETRSQYE,  SEQ ID NO:5348
RCQLGDRLNVEVDAAPTVDLNRVLNETRSQYE,  SEQ ID NO:5349
RSQLGDRLNVEVDAAPTVDLNRVLNETRSQYE,  SEQ ID NO:5350
RCPLGDRLNVEVDAAPTVDLNRVLNETRSQYE,  SEQ ID NO:5351
RSPLGDRLNVEVDAAPTVDLNRVLNETRSQYE,  SEQ ID NO:5352
RCQLGDRLNVEVDTAPTVDLNRVLNETRSQYE,  SEQ ID NO:5353
RSQLGDRLNVEVDTAPTVDLNRVLNETRSQYE,  SEQ ID NO:5354
RCPLGDRLNVEVDTAPTVDLNRVLNETRSQYE,  SEQ ID NO:5355
RSPLGDRLNVEVDTAPTVDLNRVLNETRSQYE,  SEQ ID NO:5356
RCQLGDRLNVEVDAAPTVDLNQVLNETRNQYE,  SEQ ID NO:5357
RSQLGDRLNVEVDAAPTVDLNQVLNETRNQYE,  SEQ ID NO:5358
RCPLGDRLNVEVDAAPTVDLNQVLNETRNQYE,  SEQ ID NO:5359
RSPLGDRLNVEVDAAPTVDLNQVLNETRNQYE,  SEQ ID NO:5360
RCQLGDRLNVEVDTAPTVDLNQVLNETRNQYE,  SEQ ID NO:5361
```

-continued

```
RSQLGDRLNVEVDTAPTVDLNQVLNETRNQYE,   SEQ ID NO:5362
RCPLGDRLNVEVDTAPTVDLNQVLNETRNQYE,   SEQ ID NO:5363
RSPLGDRLNVEVDTAPTVDLNQVLNETRNQYE,   SEQ ID NO:5364
RCQLGDRLNVEVDAAPTVDLNRVLNETRNQYE,   SEQ ID NO:5365
RSQLGDRLNVEVDAAPTVDLNRVLNETRNQYE,   SEQ ID NO:5366
RCPLGDRLNVEVDAAPTVDLNRVLNETRNQYE,   SEQ ID NO:5367
RSPLGDRLNVEVDAAPTVDLNRVLNETRNQYE,   SEQ ID NO:5368
RCQLGDRLNVEVDTAPTVDLNRVLNETRNQYE,   SEQ ID NO:5369
RSQLGDRLNVEVDTAPTVDLNRVLNETRNQYE,   SEQ ID NO:5370
RCPLGDRLNVEVDTAPTVDLNRVLNETRNQYE,   SEQ ID NO:5371
RSPLGDRLNVEVDTAPTVDLNRVLNETRNQYE,   SEQ ID NO:5372
CQLGDRLNVEVDAAPTVDLNQVLNETRSQYEA,   SEQ ID NO:5373
SQLGDRLNVEVDAAPTVDLNQVLNETRSQYEA,   SEQ ID NO:5374
CPLGDRLNVEVDAAPTVDLNQVLNETRSQYEA,   SEQ ID NO:5375
SPLGDRLNVEVDAAPTVDLNQVLNETRSQYEA,   SEQ ID NO:5376
CQLGDRLNVEVDTAPTVDLNQVLNETRSQYEA,   SEQ ID NO:5377
SQLGDRLNVEVDTAPTVDLNQVLNETRSQYEA,   SEQ ID NO:5378
CPLGDRLNVEVDTAPTVDLNQVLNETRSQYEA,   SEQ ID NO:5379
SPLGDRLNVEVDTAPTVDLNQVLNETRSQYEA,   SEQ ID NO:5380
CQLGDRLNVEVDAAPTVDLNRVLNETRSQYEA,   SEQ ID NO:5381
SQLGDRLNVEVDAAPTVDLNRVLNETRSQYEA,   SEQ ID NO:5382
CPLGDRLNVEVDAAPTVDLNRVLNETRSQYEA,   SEQ ID NO:5383
SPLGDRLNVEVDAAPTVDLNRVLNETRSQYEA,   SEQ ID NO:5384
CQLGDRLNVEVDTAPTVDLNRVLNETRSQYEA,   SEQ ID NO:5385
SQLGDRLNVEVDTAPTVDLNRVLNETRSQYEA,   SEQ ID NO:5386
CPLGDRLNVEVDTAPTVDLNRVLNETRSQYEA,   SEQ ID NO:5387
SPLGDRLNVEVDTAPTVDLNRVLNETRSQYEA,   SEQ ID NO:5388
CQLGDRLNVEVDAAPTVDLNQVLNETRNQYEA,   SEQ ID NO:5389
SQLGDRLNVEVDAAPTVDLNQVLNETRNQYEA,   SEQ ID NO:5390
CPLGDRLNVEVDAAPTVDLNQVLNETRNQYEA,   SEQ ID NO:5391
SPLGDRLNVEVDAAPTVDLNQVLNETRNQYEA,   SEQ ID NO:5392
CQLGDRLNVEVDTAPTVDLNQVLNETRNQYEA,   SEQ ID NO:5393
SQLGDRLNVEVDTAPTVDLNQVLNETRNQYEA,   SEQ ID NO:5394
CPLGDRLNVEVDTAPTVDLNQVLNETRNQYEA,   SEQ ID NO:5395
SPLGDRLNVEVDTAPTVDLNQVLNETRNQYEA,   SEQ ID NO:5396
CQLGDRLNVEVDAAPTVDLNRVLNETRNQYEA,   SEQ ID NO:5397
SQLGDRLNVEVDAAPTVDLNRVLNETRNQYEA,   SEQ ID NO:5398
CPLGDRLNVEVDAAPTVDLNRVLNETRNQYEA,   SEQ ID NO:5399
SPLGDRLNVEVDAAPTVDLNRVLNETRNQYEA,   SEQ ID NO:5400
CQLGDRLNVEVDTAPTVDLNRVLNETRNQYEA,   SEQ ID NO:5401
SQLGDRLNVEVDTAPTVDLNRVLNETRNQYEA,   SEQ ID NO:5402
CPLGDRLNVEVDTAPTVDLNRVLNETRNQYEA,   SEQ ID NO:5403
SPLGDRLNVEVDTAPTVDLNRVLNETRNQYEA,   SEQ ID NO:5404
QLGDRLNVEVDAAPTVDLNQVLNETRSQYEAL,   SEQ ID NO:5405
PLGDRLNVEVDAAPTVDLNQVLNETRSQYEAL,   SEQ ID NO:5406
QLGDRLNVEVDTAPTVDLNQVLNETRSQYEAL,   SEQ ID NO:5407
PLGDRLNVEVDTAPTVDLNQVLNETRSQYEAL,   SEQ ID NO:5408
QLGDRLNVEVDAAPTVDLNRVLNETRSQYEAL,   SEQ ID NO:5409
PLGDRLNVEVDAAPTVDLNRVLNETRSQYEAL,   SEQ ID NO:5410
QLGDRLNVEVDTAPTVDLNRVLNETRSQYEAL,   SEQ ID NO:5411
PLGDRLNVEVDTAPTVDLNRVLNETRSQYEAL,   SEQ ID NO:5412
QLGDRLNVEVDAAPTVDLNQVLNETRNQYEAL,   SEQ ID NO:5413
PLGDRLNVEVDAAPTVDLNQVLNETRNQYEAL,   SEQ ID NO:5414
QLGDRLNVEVDTAPTVDLNQVLNETRNQYEAL,   SEQ ID NO:5415
PLGDRLNVEVDTAPTVDLNQVLNETRNQYEAL,   SEQ ID NO:5416
QLGDRLNVEVDAAPTVDLNRVLNETRNQYEAL,   SEQ ID NO:5417
PLGDRLNVEVDAAPTVDLNRVLNETRNQYEAL,   SEQ ID NO:5418
QLGDRLNVEVDTAPTVDLNRVLNETRNQYEAL,   SEQ ID NO:5419
PLGDRLNVEVDTAPTVDLNRVLNETRNQYEAL,   SEQ ID NO:5420
EVNTLRCQLGDRLNVEVDAAPTVDLNQVLNETR,  SEQ ID NO:5421
EVNTLRSQLGDRLNVEVDAAPTVDLNQVLNETR,  SEQ ID NO:5422
EVNTLRCPLGDRLNVEVDAAPTVDLNQVLNETR,  SEQ ID NO:5423
EVNTLRSPLGDRLNVEVDAAPTVDLNQVLNETR,  SEQ ID NO:5424
EVNTLRCQLGDRLNVEVDTAPTVDLNQVLNETR,  SEQ ID NO:5425
EVNTLRSQLGDRLNVEVDTAPTVDLNQVLNETR,  SEQ ID NO:5426
EVNTLRCPLGDRLNVEVDTAPTVDLNQVLNETR,  SEQ ID NO:5427
EVNTLRSPLGDRLNVEVDTAPTVDLNQVLNETR,  SEQ ID NO:5428
EVNTLRCQLGDRLNVEVDAAPTVDLNRVLNETR,  SEQ ID NO:5429
EVNTLRSQLGDRLNVEVDAAPTVDLNRVLNETR,  SEQ ID NO:5430
EVNTLRCPLGDRLNVEVDAAPTVDLNRVLNETR,  SEQ ID NO:5431
EVNTLRSPLGDRLNVEVDAAPTVDLNRVLNETR,  SEQ ID NO:5432
EVNTLRCQLGDRLNVEVDTAPTVDLNRVLNETR,  SEQ ID NO:5433
EVNTLRSQLGDRLNVEVDTAPTVDLNRVLNETR,  SEQ ID NO:5434
EVNTLRCPLGDRLNVEVDTAPTVDLNRVLNETR,  SEQ ID NO:5435
EVNTLRSPLGDRLNVEVDTAPTVDLNRVLNETR,  SEQ ID NO:5436
VNTLRCQLGDRLNVEVDAAPTVDLNQVLNETRS,  SEQ ID NO:5437
VNTLRSQLGDRLNVEVDAAPTVDLNQVLNETRS,  SEQ ID NO:5438
VNTLRCPLGDRLNVEVDAAPTVDLNQVLNETRS,  SEQ ID NO:5439
VNTLRSPLGDRLNVEVDAAPTVDLNQVLNETRS,  SEQ ID NO:5440
VNTLRCQLGDRLNVEVDTAPTVDLNQVLNETRS,  SEQ ID NO:5441
```

-continued

```
VNTLRSQLGDRLNVEVDTAPTVDLNQVLNETRS,  SEQ ID NO:5442
VNTLRCPLGDRLNVEVDTAPTVDLNQVLNETRS,  SEQ ID NO:5443
VNTLRSPLGDRLNVEVDTAPTVDLNQVLNETRS,  SEQ ID NO:5444
VNTLRCQLGDRLNVEVDAAPTVDLNRVLNETRS,  SEQ ID NO:5445
VNTLRSQLGDRLNVEVDAAPTVDLNRVLNETRS,  SEQ ID NO:5446
VNTLRCPLGDRLNVEVDAAPTVDLNRVLNETRS,  SEQ ID NO:5447
VNTLRSPLGDRLNVEVDAAPTVDLNRVLNETRS,  SEQ ID NO:5448
VNTLRCQLGDRLNVEVDTAPTVDLNRVLNETRS,  SEQ ID NO:5449
VNTLRSQLGDRLNVEVDTAPTVDLNRVLNETRS,  SEQ ID NO:5450
VNTLRCPLGDRLNVEVDTAPTVDLNRVLNETRS,  SEQ ID NO:5451
VNTLRSPLGDRLNVEVDTAPTVDLNRVLNETRS,  SEQ ID NO:5452
VNTLRCQLGDRLNVEVDAAPTVDLNQVLNETRN,  SEQ ID NO:5453
VNTLRSQLGDRLNVEVDAAPTVDLNQVLNETRN,  SEQ ID NO:5454
VNTLRCPLGDRLNVEVDAAPTVDLNQVLNETRN,  SEQ ID NO:5455
VNTLRSPLGDRLNVEVDAAPTVDLNQVLNETRN,  SEQ ID NO:5456
VNTLRCQLGDRLNVEVDTAPTVDLNQVLNETRN,  SEQ ID NO:5457
VNTLRSQLGDRLNVEVDTAPTVDLNQVLNETRN,  SEQ ID NO:5458
VNTLRCPLGDRLNYEVDTAPTVDLNQVLNETRN,  SEQ ID NO:5459
VNTLRSPLGDRLNVEVDTAPTVDLNQVLNETRN,  SEQ ID NO:5460
VNTLRCQLGDRLNVEVDAAPTVDLNRVLNETRN,  SEQ ID NO:5461
VNTLRSQLGDRLNVEVDAAPTVDLNRVLNETRN,  SEQ ID NO:5462
VNTLRCPLGDRLNVEVDAAPTVDLNRVLNETRN,  SEQ ID NO:5463
VNTLRSPLGDRLNVEVDAAPTVDLNRVLNETRN,  SEQ ID NO:5464
VNTLRCQLGDRLNVEVDTAPTVDLNRVLNETRN,  SEQ ID NO:5465
VNTLRSQLGDRLNVEVDTAPTVDLNRVLNETRN,  SEQ ID NO:5466
VNTLRCPLGDRLNVEVDTAPTVDLNRVLNETRN,  SEQ ID NO:5467
VNTLRSPLGDRLNVEVDTAPTVDLNRVLNETRN,  SEQ ID NO:5468
NTLRCQLGDRLNVEVDAAPTVDLNQVLNETRSQ,  SEQ ID NO:5469
NTLRSQLGDRLNVEVDAAPTVDLNQVLNETRSQ,  SEQ ID NO:5470
NTLRCPLGDRLNVEVDAAPTVDLNQVLNETRSQ,  SEQ ID NO:5471
NTLRSPLGDRLNVEVDAAPTVDLNQVLNETRSQ,  SEQ ID NO:5472
NTLRCQLGDRLNVEVDTAPTVDLNQVLNETRSQ,  SEQ ID NO:5473
NTLRSQLGDRLNVEVDTAPTVDLNQVLNETRSQ,  SEQ ID NO:5474
NTLRCPLGDRLNVEVDTAPTVDLNQVLNETRSQ,  SEQ ID NO:5475
NTLRSPLGDRLNVEVDTAPTVDLNQVLNETRSQ,  SEQ ID NO:5476
NTLRCQLGDRLNVEVDAAPTVDLNRVLNETRSQ,  SEQ ID NO:5477
NTLRSQLGDRLNVEVDAAPTVDLNRVLNETRSQ,  SEQ ID NO:5478
NTLRCPLGDRLNVEVDAAPTVDLNRVLNETRSQ,  SEQ ID NO:5479
NTLRSPLGDRLNVEVDAAPTVDLNRVLNETRSQ,  SEQ ID NO:5480
NTLRCQLGDRLNVEVDTAPTVDLNRVLNETRSQ,  SEQ ID NO:5481
NTLRSQLGDRLNVEVDTAPTVDLNRVLNETRSQ,  SEQ ID NO:5482
NTLRCPLGDRLNVEVDTAPTVDLNRVLNETRSQ,  SEQ ID NO:5483
NTLRSPLGDRLNVEVDTAPTVDLNRVLNETRSQ,  SEQ ID NO:5484
NTLRCQLGDRLNVEVDAAPTVDLNQVLNETRNQ,  SEQ ID NO:5485
NTLRSQLGDRLNVEVDAAPTVDLNQVLNETRNQ,  SEQ ID NO:5486
NTLRCPLGDRLNVEVDAAPTVDLNQVLNETRNQ,  SEQ ID NO:5487
NTLRSPLGDRLNVEVDAAPTVDLNQVLNETRNQ,  SEQ ID NO:5488
NTLRCQLGDRLNVEVDTAPTVDLNQVLNETRNQ,  SEQ ID NO:5489
NTLRSQLGDRLNVEVDTAPTVDLNQVLNETRNQ,  SEQ ID NO:5490
NTLRCPLGDRLNVEVDTAPTVDLNQVLNETRNQ,  SEQ ID NO:5491
NTLRSPLGDRLNVEVDTAPTVDLNQVLNETRNQ,  SEQ ID NO:5492
NTLRCQLGDRLNVEVDAAPTVDLNRVLNETRNQ,  SEQ ID NO:5493
NTLRSQLGDRLNVEVDAAPTVDLNRVLNETRNQ,  SEQ ID NO:5494
NTLRCPLGDRLNVEVDAAPTVDLNRVLNETRNQ,  SEQ ID NO:5495
NTLRSPLGDRLNVEVDAAPTVDLNRVLNETRNQ,  SEQ ID NO:5496
NTLRCQLGDRLNVEVDTAPTVDLNRVLNETRNQ,  SEQ ID NO:5497
NTLRSQLGDRLNVEVDTAPTVDLNRVLNETRNQ,  SEQ ID NO:5498
NTLRCPLGDRLNVEVDTAPTVDLNRVLNETRNQ,  SEQ ID NO:5499
NTLRSPLGDRLNVEVDTAPTVDLNRVLNETRNQ,  SEQ ID NO:5500
TLRCQLGDRLNVEVDAAPTVDLNQVLNETRSQY,  SEQ ID NO:5501
TLRSQLGDRLNVEVDAAPTVDLNQVLNETRSQY,  SEQ ID NO:5502
TLRCPLGDRLNVEVDAAPTVDLNQVLNETRSQY,  SEQ ID NO:5503
TLRSPLGDRLNVEVDAAPTVDLNQVLNETRSQY,  SEQ ID NO:5504
TLRCQLGDRLNVEVDTAPTVDLNQVLNETRSQY,  SEQ ID NO:5505
TLRSQLGDRLNVEVDTAPTVDLNQVLNETRSQY,  SEQ ID NO:5506
TLRCPLGDRLNVEVDTAPTVDLNQVLNETRSQY,  SEQ ID NO:5507
TLRSPLGDRLNVEVDTAPTVDLNQVLNETRSQY,  SEQ ID NO:5508
TLRCQLGDRLNVEVDAAPTVDLNRVLNETRSQY,  SEQ ID NO:5509
TLRSQLGDRLNVEVDAAPTVDLNRVLNETRSQY,  SEQ ID NO:5510
TLRCPLGDRLNVEVDAAPTVDLNRVLNETRSQY,  SEQ ID NO:5511
TLRSPLGDRLNVEVDAAPTVDLNRVLNETRSQY,  SEQ ID NO:5512
TLRCQLGDRLNVEVDTAPTVDLNRVLNETRSQY,  SEQ ID NO:5513
TLRSQLGDRLNVEVDTAPTVDLNRVLNETRSQY,  SEQ ID NO:5514
TLRCPLGDRLNVEVDTAPTVDLNRVLNETRSQY,  SEQ ID NO:5515
TLRSPLGDRLNVEVDTAPTVDLNRVLNETRSQY,  SEQ ID NO:5516
TLRCQLGDRLNVEVDAAPTVDLNQVLNETRNQY,  SEQ ID NO:5517
TLRSQLGDRLNVEVDAAPTVDLNQVLNETRNQY,  SEQ ID NO:5518
TLRCPLGDRLNVEVDAAPTVDLNQVLNETRNQY,  SEQ ID NO:5519
TLRSPLGDRLNVEVDAAPTVDLNQVLNETRNQY,  SEQ ID NO:5520
TLRCQLGDRLNVEVDTAPTVDLNQVLNETRNQY,  SEQ ID NO:5521
```

-continued

```
TLRSQLGDRLNVEVDTAPTVDLNQVLNETRNQY,  SEQ ID NO:5522
TLRCPLGDRLNVEVDTAPTVDLNQVLNETRNQY,  SEQ ID NO:5523
TLRSPLGDRLNVEVDTAPTVDLNQVLNETRNQY,  SEQ ID NO:5524
TLRCQLGDRLNVEVDAAPTVDLNRVLNETRNQY,  SEQ ID NO:5525
TLRSQLGDRLNVEVDAAPTVDLNRVLNETRNQY,  SEQ ID NO:5526
TLRCPLGDRLNVEVDAAPTVDLNRVLNETRNQY,  SEQ ID NO:5527
TLRSPLGDRLNVEVDAAPTVDLNRVLNETRNQY,  SEQ ID NO:5528
TLRCQLGDRLNVEVDTAPTVDLNRVLNETRNQY,  SEQ ID NO:5529
TLRSQLGDRLNVEVDTAPTVDLNRVLNETRNQY,  SEQ ID NO:5530
TLRCPLGDRLNVEVDTAPTVDLNRVLNETRNQY,  SEQ ID NO:5531
TLRSPLGDRLNVEVDTAPTVDLNRVLNETRNQY,  SEQ ID NO:5532
LRCQLGDRLNVEVDAAPTVDLNQVLNETRSQYE,  SEQ ID NO:5533
LRSQLGDRLNVEVDAAPTVDLNQVLNETRSQYE,  SEQ ID NO:5534
LRCPLGDRLNVEVDAAPTVDLNQVLNETRSQYE,  SEQ ID NO:5535
LRSPLGDRLNVEVDAAPTVDLNQVLNETRSQYE,  SEQ ID NO:5536
LRCQLGDRLNVEVDTAPTVDLNQVLNETRSQYE,  SEQ ID NO:5537
LRSQLGDRLNVEVDTAPTVDLNQVLNETRSQYE,  SEQ ID NO:5538
LRCPLGDRLNVEVDTAPTVDLNQVLNETRSQYE,  SEQ ID NO:5539
LRSPLGDRLNVEVDTAPTVDLNQVLNETRSQYE,  SEQ ID NO:5540
LRCQLGDRLNVEVDAAPTVDLNRVLNETRSQYE,  SEQ ID NO:5541
LRSQLGDRLNVEVDAAPTVDLNRVLNETRSQYE,  SEQ ID NO:5542
LRCPLGDRLNVEVDAAPTVDLNRVLNETRSQYE,  SEQ ID NO:5543
LRSPLGDRLNVEVDAAPTVDLNRVLNETRSQYE,  SEQ ID NO:5544
LRCQLGDRLNVEVDTAPTVDLNRVLNETRSQYE,  SEQ ID NO:5545
LRSQLGDRLNVEVDTAPTVDLNRVLNETRSQYE,  SEQ ID NO:5546
LRCPLGDRLNVEVDTAPTVDLNRVLNETRSQYE,  SEQ ID NO:5547
LRSPLGDRLNVEVDTAPTVDLNRVLNETRSQYE,  SEQ ID NO:5548
LRCQLGDRLNVEVDAAPTVDLNQVLNETRNQYE,  SEQ ID NO:5549
LRSQLGDRLNVEVDAAPTVDLNQVLNETRNQYE,  SEQ ID NO:5550
LRCPLGDRLNVEVDAAPTVDLNQVLNETRNQYE,  SEQ ID NO:5551
LRSPLGDRLNVEVDAAPTVDLNQVLNETRNQYE,  SEQ ID NO:5552
LRCQLGDRLNVEVDTAPTVDLNQVLNETRNQYE,  SEQ ID NO:5553
LRSQLGDRLNVEVDTAPTVDLNQVLNETRNQYE,  SEQ ID NO:5554
LRCPLGDRLNVEVDTAPTVDLNQVLNETRNQYE,  SEQ ID NO:5555
LRSPLGDRLNVEVDTAPTVDLNQVLNETRNQYE,  SEQ ID NO:5556
LRCQLGDRLNVEVDAAPTVDLNRVLNETRNQYE,  SEQ ID NO:5557
LRSQLGDRLNVEVDAAPTVDLNRVLNETRNQYE,  SEQ ID NO:5558
LRCPLGDRLNVEVDAAPTVDLNRVLNETRNQYE,  SEQ ID NO:5559
LRSPLGDRLNVEVDAAPTVDLNRVLNETRNQYE,  SEQ ID NO:5560
LRCQLGDRLNVEVDTAPTVDLNRVLNETRNQYE,  SEQ ID NO:5561
LRSQLGDRLNVEVDTAPTVDLNRVLNETRNQYE,  SEQ ID NO:5562
LRCPLGDRLNVEVDTAPTVDLNRVLNETRNQYE,  SEQ ID NO:5563
LRSPLGDRLNVEVDTAPTVDLNRVLNETRNQYE,  SEQ ID NO:5564
RCQLGDRLNVEVDAAPTVDLNQVLNETRSQYEA,  SEQ ID NO:5565
RSQLGDRLNVEVDAAPTVDLNQVLNETRSQYEA,  SEQ ID NO:5566
RCPLGDRLNVEVDAAPTVDLNQVLNETRSQYEA,  SEQ ID NO:5567
RSPLGDRLNVEVDAAPTVDLNQVLNETRSQYEA,  SEQ ID NO:5568
RCQLGDRLNVEVDTAPTVDLNQVLNETRSQYEA,  SEQ ID NO:5569
RSQLGDRLNVEVDTAPTVDLNQVLNETRSQYEA,  SEQ ID NO:5570
RCPLGDRLNVEVDTAPTVDLNQVLNETRSQYEA,  SEQ ID NO:5571
RSPLGDRLNVEVDTAPTVDLNQVLNETRSQYEA,  SEQ ID NO:5572
RCQLGDRLNVEVDAAPTVDLNRVLNETRSQYEA,  SEQ ID NO:5573
RSQLGDRLNVEVDAAPTVDLNRVLNETRSQYEA,  SEQ ID NO:5574
RCPLGDRLNVEVDAAPTVDLNRVLNETRSQYEA,  SEQ ID NO:5575
RSPLGDRLNVEVDAAPTVDLNRVLNETRSQYEA,  SEQ ID NO:5576
RCQLGDRLNVEVDTAPTVDLNRVLNETRSQYEA,  SEQ ID NO:5577
RSQLGDRLNVEVDTAPTVDLNRVLNETRSQYEA,  SEQ ID NO:5578
RCPLGDRLNVEVDTAPTVDLNRVLNETRSQYEA,  SEQ ID NO:5579
RSPLGDRLNVEVDTAPTVDLNRVLNETRSQYEA,  SEQ ID NO:5580
RCQLGDRLNVEVDAAPTVDLNQVLNETRNQYEA,  SEQ ID NO:5581
RSQLGDRLNVEVDAAPTVDLNQVLNETRNQYEA,  SEQ ID NO:5582
RCPLGDRLNVEVDAAPTVDLNQVLNETRNQYEA,  SEQ ID NO:5583
RSPLGDRLNVEVDAAPTVDLNQVLNETRNQYEA,  SEQ ID NO:5584
RCQLGDRLNVEVDTAPTVDLNQVLNETRNQYEA,  SEQ ID NO:5585
RSQLGDRLNVEVDTAPTVDLNQVLNETRNQYEA,  SEQ ID NO:5586
RCPLGDRLNVEVDTAPTVDLNQVLNETRNQYEA,  SEQ ID NO:5587
RSPLGDRLNVEVDTAPTVDLNQVLNETRNQYEA,  SEQ ID NO:5588
RCQLGDRLNVEVDAAPTVDLNRVLNETRNQYEA,  SEQ ID NO:5589
RSQLGDRLNVEVDAAPTVDLNRVLNETRNQYEA,  SEQ ID NO:5590
RCPLGDRLNVEVDAAPTVDLNRVLNETRNQYEA,  SEQ ID NO:5591
RSPLGDRLNVEVDAAPTVDLNRVLNETRNQYEA,  SEQ ID NO:5592
RCQLGDRLNVEVDTAPTVDLNRVLNETRNQYEA,  SEQ ID NO:5593
RSQLGDRLNVEVDTAPTVDLNRVLNETRNQYEA,  SEQ ID NO:5594
RCPLGDRLNVEVDTAPTVDLNRVLNETRNQYEA,  SEQ ID NO:5595
RSPLGDRLNVEVDTAPTVDLNRVLNETRNQYEA,  SEQ ID NO:5596
CQLGDRLNVEVDAAPTVDLNQVLNETRSQYEAL, SEQ ID NO:5597
SQLGDRLNVEVDAAPTVDLNQVLNETRSQYEAL, SEQ ID NO:5598
CPLGDRLNVEVDAAPTVDLNQVLNETRSQYEAL, SEQ ID NO:5599
SPLGDRLNVEVDAAPTVDLNQVLNETRSQYEAL, SEQ ID NO:5600
CQLGDRLNVEVDTAPTVDLNQVLNETRSQYEAL, SEQ ID NO:5601
```

```
SQLGDRLNVEVDTAPTVDLNQVLNETRSQYEAL,   SEQ ID NO:5602
CPLGDRLNVEVDTAPTVDLNQVLNETRSQYEAL,   SEQ ID NO:5603
SPLGDRLNVEVDTAPTVDLNQVLNETRSQYEAL,   SEQ ID NO:5604
CQLGDRLNVEVDAAPTVDLNRVLNETRSQYEAL,   SEQ ID NO:5605
SQLGDRLNVEVDAAPTVDLNRVLNETRSQYEAL,   SEQ ID NO:5606
CPLGDRLNVEVDAAPTVDLNRVLNETRSQYEAL,   SEQ ID NO:5607
SPLGDRLNVEVDAAPTVDLNRVLNETRSQYEAL,   SEQ ID NO:5608
CQLGDRLNVEVDTAPTVDLNRVLNETRSQYEAL,   SEQ ID NO:5609
SQLGDRLNVEVDTAPTVDLNRVLNETRSQYEAL,   SEQ ID NO:5610
CPLGDRLNVEVDTAPTVDLNRVLNETRSQYEAL,   SEQ ID NO:5611
SPLGDRLNVEVDTAPTVDLNRVLNETRSQYEAL,   SEQ ID NO:5612
CQLGDRLNVEVDAAPTVDLNQVLNETRNQYEAL,   SEQ ID NO:5613
SQLGDRLNVEVDAAPTVDLNQVLNETRNQYEAL,   SEQ ID NO:5614
CPLGDRLNVEVDAAPTVDLNQVLNETRNQYEAL,   SEQ ID NO:5615
SPLGDRLNVEVDAAPTVDLNQVLNETRNQYEAL,   SEQ ID NO:5616
CQLGDRLNVEVDTAPTVDLNQVLNETRNQYEAL,   SEQ ID NO:5617
SQLGDRLNVEVDTAPTVDLNQVLNETRNQYEAL,   SEQ ID NO:5618
CPLGDRLNVEVDTAPTVDLNQVLNETRNQYEAL,   SEQ ID NO:5619
SPLGDRLNVEVDTAPTVDLNQVLNETRNQYEAL,   SEQ ID NO:5620
CQLGDRLNVEVDAAPTVDLNRVLNETRNQYEAL,   SEQ ID NO:5621
SQLGDRLNVEVDAAPTVDLNRVLNETRNQYEAL,   SEQ ID NO:5622
CPLGDRLNVEVDAAPTVDLNRVLNETRNQYEAL,   SEQ ID NO:5623
SPLGDRLNVEVDAAPTVDLNRVLNETRNQYEAL,   SEQ ID NO:5624
CQLGDRLNVEVDTAPTVDLNRVLNETRNQYEAL,   SEQ ID NO:5625
SQLGDRLNVEVDTAPTVDLNRVLNETRNQYEAL,   SEQ ID NO:5626
CPLGDRLNVEVDTAPTVDLNRVLNETRNQYEAL,   SEQ ID NO:5627
SPLGDRLNVEVDTAPTVDLNRVLNETRNQYEAL,   SEQ ID NO:5628
EVNTLRCQLGDRLNVEVDAAPTVDLNQVLNETRS,  SEQ ID NO:5629
EVNTLRSQLGDRLNVEVDAAPTVDLNQVLNETRS,  SEQ ID NO:5630
EVNTLRCPLGDRLNVEVDAAPTVDLNQVLNETRS,  SEQ ID NO:5631
EVNTLRSPLGDRLNVEVDAAPTVDLNQVLNETRS,  SEQ ID NO:5632
EVNTLRCQLGDRLNVEVDTAPTVDLNQVLNETRS,  SEQ ID NO:5633
EVNTLRSQLGDRLNVEVDTAPTVDLNQVLNETRS,  SEQ ID NO:5634
EVNTLRCPLGDRLNVEVDTAPTVDLNQVLNETRS,  SEQ ID NO:5635
EVNTLRSPLGDRLNVEVDTAPTVDLNQVLNETRS,  SEQ ID NO:5636
EVNTLRCQLGDRLNVEVDAAPTVDLNRVLNETRS,  SEQ ID NO:5637
EVNTLRSQLGDRLNVEVDAAPTVDLNRVLNETRS,  SEQ ID NO:5638
EVNTLRCPLGDRLNVEVDAAPTVDLNRVLNETRS,  SEQ ID NO:5639
EVNTLRSPLGDRLNVEVDAAPTVDLNRVLNETRS,  SEQ ID NO:5640
EVNTLRCQLGDRLNVEVDTAPTVDLNRVLNETRS,  SEQ ID NO:5641
EVNTLRSQLGDRLNVEVDTAPTVDLNRVLNETRS,  SEQ ID NO:5642
EVNTLRCPLGDRLNVEVDTAPTVDLNRVLNETRS,  SEQ ID NO:5643
EVNTLRSPLGDRLNVEVDTAPTVDLNRVLNETRS,  SEQ ID NO:5644
EVNTLRCQLGDRLNVEVDAAPTVDLNQVLNETRN,  SEQ ID NO:5645
EVNTLRSQLGDRLNVEVDAAPTVDLNQVLNETRN,  SEQ ID NO:5646
EVNTLRCPLGDRLNVEVDAAPTVDLNQVLNETRN,  SEQ ID NO:5647
EVNTLRSPLGDRLNVEVDAAPTVDLNQVLNETRN,  SEQ ID NO:5648
EVNTLRCQLGDRLNVEVDTAPTVDLNQVLNETRN,  SEQ ID NO:5649
EVNTLRSQLGDRLNVEVDTAPTVDLNQVLNETRN,  SEQ ID NO:5650
EVNTLRCPLGDRLNVEVDTAPTVDLNQVLNETRN,  SEQ ID NO:5651
EVNTLRSPLGDRLNVEVDTAPTVDLNQVLNETRN,  SEQ ID NO:5652
EVNTLRCQLGDRLNVEVDAAPTVDLNRVLNETRN,  SEQ ID NO:5653
EVNTLRSQLGDRLNVEVDAAPTVDLNRVLNETRN,  SEQ ID NO:5654
EVNTLRCPLGDRLNVEVDAAPTVDLNRVLNETRN,  SEQ ID NO:5655
EVNTLRSPLGDRLNVEVDAAPTVDLNRVLNETRN,  SEQ ID NO:5656
EVNTLRCQLGDRLNVEVDTAPTVDLNRVLNETRN,  SEQ ID NO:5657
EVNTLRSQLGDRLNVEVDTAPTVDLNRVLNETRN,  SEQ ID NO:5658
EVNTLRCPLGDRLNVEVDTAPTVDLNRVLNETRN,  SEQ ID NO:5659
EVNTLRSPLGDRLNVEVDTAPTVDLNRVLNETRN,  SEQ ID NO:5660
VNTLRCQLGDRLNVEVDAAPTVDLNQVLNETRSQ,  SEQ ID NO:5661
VNTLRSQLGDRLNVEVDAAPTVDLNQVLNETRSQ,  SEQ ID NO:5662
VNTLRCPLGDRLNVEVDAAPTVDLNQVLNETRSQ,  SEQ ID NO:5663
VNTLRSPLGDRLNVEVDAAPTVDLNQVLNETRSQ,  SEQ ID NO:5664
VNTLRCQLGDRLNVEVDTAPTVDLNQVLNETRSQ,  SEQ ID NO:5665
VNTLRSQLGDRLNVEVDTAPTVDLNQVLNETRSQ,  SEQ ID NO:5666
VNTLRCPLGDRLNVEVDTAPTVDLNQVLNETRSQ,  SEQ ID NO:5667
VNTLRSPLGDRLNVEVDTAPTVDLNQVLNETRSQ,  SEQ ID NO:5668
VNTLRCQLGDRLNVEVDAAPTVDLNRVLNETRSQ,  SEQ ID NO:5669
VNTLRSQLGDRLNVEVDAAPTVDLNRVLNETRSQ,  SEQ ID NO:5670
VNTLRCPLGDRLNVEVDAAPTVDLNRVLNETRSQ,  SEQ ID NO:5671
VNTLRSPLGDRLNVEVDAAPTVDLNRVLNETRSQ,  SEQ ID NO:5672
VNTLRCQLGDRLNVEVDTAPTVDLNRVLNETRSQ,  SEQ ID NO:5673
VNTLRSQLGDRLNVEVDTAPTVDLNRVLNETRSQ,  SEQ ID NO:5674
VNTLRCPLGDRLNVEVDTAPTVDLNRVLNETRSQ,  SEQ ID NO:5675
VNTLRSPLGDRLNVEVDTAPTVDLNRVLNETRSQ,  SEQ ID NO:5676
VNTLRCQLGDRLNVEVDAAPTVDLNQVLNETRNQ,  SEQ ID NO:5678
VNTLRSQLGDRLNVEVDAAPTVDLNQVLNETRNQ,  SEQ ID NO:5679
VNTLRCPLGDRLNVEVDAAPTVDLNQVLNETRNQ,  SEQ ID NO:5680
VNTLRSPLGDRLNVEVDAAPTVDLNQVLNETRNQ,  SEQ ID NO:5681
VNTLRCQLGDRLNVEVDTAPTVDLNQVLNETRNQ,  SEQ ID NO:5682
```

```
VNTLRSQLGDRLNVEVDTAPTVDLNQVLNETRNQ,   SEQ ID NO:5683
VNTLRCPLGDRLNVEVDTAPTVDLNQVLNETRNQ,   SEQ ID NO:5684
VNTLRSPLGDRLNVEVDTAPTVDLNQVLNETRNQ,   SEQ ID NO:5685
VNTLRCQLGDRLNVEVDAAPTVDLNRVLNETRNQ,   SEQ ID NO:5686
VNTLRSQLGDRLNVEVDAAPTVDLNRVLNETRNQ,   SEQ ID NO:5687
VNTLRCPLGDRLNVEVDAAPTVDLNRVLNETRNQ,   SEQ ID NO:5688
VNTLRSPLGDRLNVEVDAAPTVDLNRVLNETRNQ,   SEQ ID NO:5689
VNTLRCQLGDRLNVEVDTAPTVDLNRVLNETRNQ,   SEQ ID NO:5690
VNTLRSQLGDRLNVEVDTAPTVDLNRVLNETRNQ,   SEQ ID NO:5691
VNTLRCPLGDRLNVEVDTAPTVDLNRVLNETRNQ,   SEQ ID NO:5692
VNTLRSPLGDRLNVEVDTAPTVDLNRVLNETRNQ,   SEQ ID NO:5693
NTLRCQLGDRLNVEVDAAPTVDLNQVLNETRSQY,   SEQ ID NO:5694
NTLRSQLGDRLNVEVDAAPTVDLNQVLNETRSQY,   SEQ ID NO:5695
NTLRCPLGDRLNVEVDAAPTVDLNQVLNETRSQY,   SEQ ID NO:5696
NTLRSPLGDRLNVEVDAAPTVDLNQVLNETRSQY,   SEQ ID NO:5697
NTLRCQLGDRLNVEVDTAPTVDLNQVLNETRSQY,   SEQ ID NO:5698
NTLRSQLGDRLNVEVDTAPTVDLNQVLNETRSQY,   SEQ ID NO:5699
NTLRCPLGDRLNVEVDTAPTVDLNQVLNETRSQY,   SEQ ID NO:5700
NTLRSPLGDRLNVEVDTAPTVDLNQVLNETRSQY,   SEQ ID NO:5701
NTLRCQLGDRLNVEVDAAPTVDLNRVLNETRSQY,   SEQ ID NO:5702
NTLRSQLGDRLNVEVDAAPTVDLNRVLNETRSQY,   SEQ ID NO:5703
NTLRCPLGDRLNVEVDAAPTVDLNRVLNETRSQY,   SEQ ID NO:5704
NTLRSPLGDRLNVEVDAAPTVDLNRVLNETRSQY,   SEQ ID NO:5705
NTLRCQLGDRLNVEVDTAPTVDLNRVLNETRSQY,   SEQ ID NO:5706
NTLRSQLGDRLNVEVDTAPTVDLNRVLNETRSQY,   SEQ ID NO:5077
NTLRCPLGDRLNVEVDTAPTVDLNRVLNETRSQY,   SEQ ID NO:5708
NTLRSPLGDRLNVEVDTAPTVDLNRVLNETRSQY,   SEQ TD NO:5709
NTLRCQLGDRLNVEVDAAPTVDLNQVLNETRNQY,   SEQ ID NO:5710
NTLRSQLGDRLNVEVDAAPTVDLNQVLNETRNQY,   SEQ ID NO:5711
NTLRCPLGDRLNVEVDAAPTVDLNQVLNETRNQY,   SEQ ID NO:5712
NTLRSPLGDRLNVEVDAAPTVDLNQVLNETRNQY,   SEQ ID NO:5713
NTLRCQLGDRLNVEVDTAPTVDLNQVLNETRNQY,   SEQ ID NO:5714
NTLRSQLGDRLNVEVDTAPTVDLNQVLNETRNQY,   SEQ ID NO:5715
NTLRCPLGDRLNVEVDTAPTVDLNQVLNETRNQY,   SEQ ID NO:5716
NTLRSPLGDRLNVEVDTAPTVDLNQVLNETRNQY,   SEQ ID NO:5717
NTLRCQLGDRLNVEVDAAPTVDLNRVLNETRNQY,   SEQ ID NO:5718
NTLRSQLGDRLNVEVDAAPTVDLNRVLNETRNQY,   SEQ ID NO:5719
NTLRCPLGDRLNVEVDAAPTVDLNRVLNETRNQY,   SEQ ID NO:5720
NTLRSPLGDRLNVEVDAAPTVDLNRVLNETRNQY,   SEQ ID NO:5721
NTLRCQLGDRLNVEVDTAPTVDLNRVLNETRNQY,   SEQ ID NO:5722
NTLRSQLGDRLNVEVDTAPTVDLNRVLNETRNQY,   SEQ ID NO:5723
NTLRCPLGDRLNVEVDTAPTVDLNRVLNETRNQY,   SEQ ID NO:5724
NTLRSPLGDRLNVEVDTAPTVDLNRVLNETRNQY,   SEQ ID NO:5725
TLRCQLGDRLNVEVDAAPTVDLNQVLNETRSQYE,   SEQ ID NO:5726
TLRSQLGDRLNVEVDAAPTVDLNQVLNETRSQYE,   SEQ ID NO:5727
TLRCPLGDRLNVEVDAAPTVDLNQVLNETRSQYE,   SEQ ID NO:5728
TLRSPLGDRLNVEVDAAPTVDLNQVLNETRSQYE,   SEQ ID NO:5729
TLRCQLGDRLNVEVDTAPTVDLNQVLNETRSQYE,   SEQ ID NO:5730
TLRSQLGDRLNVEVDTAPTVDLNQVLNETRSQYE,   SEQ ID NO:5731
TLRCPLGDRLNVEVDTAPTVDLNQVLNETRSQYE,   SEQ ID NO:5732
TLRSPLGDRLNVEVDTAPTVDLNQVLNETRSQYE,   SEQ ID NO:5733
TLRCQLGDRLNVEVDAAPTVDLNRVLNETRSQYE,   SEQ ID NO:5734
TLRSQLGDRLNVEVDAAPTVDLNRVLNETRSQYE,   SEQ ID NO:5735
TLRCPLGDRLNVEVDAAPTVDLNRVLNETRSQYE,   SEQ ID NO:5736
TLRSPLGDRLNVEVDAAPTVDLNRVLNETRSQYE,   SEQ ID NO:5737
TLRCQLGDRLNVEVDTAPTVDLNRVLNETRSQYE,   SEQ ID NO:5738
TLRSQLGDRLNVEVDTAPTVDLNRVLNETRSQYE,   SEQ ID NO:5739
TLRCPLGDRLNVEVDTAPTVDLNRVLNETRSQYE,   SEQ ID NO:5740
TLRSPLGDRLNVEVDTAPTVDLNRVLNETRSQYE,   SEQ ID NO:5741
TLRCQLGDRLNVEVDAAPTVDLNQVLNETRNQYE,   SEQ ID NO:5742
TLRSQLGDRLNVEVDAAPTVDLNQVLNETRNQYE,   SEQ ID NO:5743
TLRCPLGDRLNVEVDAAPTVDLNQVLNETRNQYE,   SEQ ID NO:5744
TLRSPLGDRLNVEVDAAPTVDLNQVLNETRNQYE,   SEQ ID NO:5745
TLRCQLGDRLNVEVDTAPTVDLNQVLNETRNQYE,   SEQ ID NO:5746
TLRSQLGDRLNVEVDTAPTVDLNQVLNETRNQYE,   SEQ ID NO:5747
TLRCPLGDRLNVEVDTAPTVDLNQVLNETRNQYE,   SEQ ID NO:5748
TLRSPLGDRLNVEVDTAPTVDLNQVLNETRNQYE,   SEQ ID NO:5749
TLRCQLGDRLNVEVDAAPTVDLNRVLNETRNQYE,   SEQ ID NO:5750
TLRSQLGDRLNVEVDAAPTVDLNRVLNETRNQYE,   SEQ ID NO:5751
TLRCPLGDRLNVEVDAAPTVDLNRVLNETRNQYE,   SEQ ID NO:5752
TLRSPLGDRLNVEVDAAPTVDLNRVLNETRNQYE,   SEQ ID NO:5753
TLRCQLGDRLNVEVDTAPTVDLNRVLNETRNQYE,   SEQ ID NO:5754
TLRSQLGDRLNVEVDTAPTVDLNRVLNETRNQYE,   SEQ ID NO:5755
TLRCPLGDRLNVEVDTAPTVDLNRVLNETRNQYE,   SEQ ID NO:5756
TLRSPLGDRLNVEVDTAPTVDLNRVLNETRNQYE,   SEQ ID NO:5757
LRCQLGDRLNVEVDAAPTVDLNQVLNETRSQYEA,   SEQ ID NO:5758
LRSQLGDRLNVEVDAAPTVDLNQVLNETRSQYEA,   SEQ ID NO:5759
LRCPLGDRLNVEVDAAPTVDLNQVLNETRSQYEA,   SEQ ID NO:5760
LRSPLGDRLNVEVDAAPTVDLNQVLNETRSQYEA,   SEQ ID NO:5761
LRCQLGDRLNVEVDTAPTVDLNQVLNETRSQYEA,   SEQ ID NO:5762
```

-continued

```
LRSQLGDRLNVEVDTAPTVDLNQVLNETRSQYEA,   SEQ ID NO:5763
LRCPLGDRLNVEVDTAPTVDLNQVLNETRSQYEA,   SEQ ID NO:5764
LRSPLGDRLNVEVDTAPTVDLNQVLNETRSQYEA,   SEQ ID NO:5765
LRCQLGDRLNVEVDAAPTVDLNRVLNETRSQYEA,   SEQ ID NO:5766
LRSQLGDRLNVEVDAAPTVDLNRVLNETRSQYEA,   SEQ ID NO:5767
LRCPLGDRLNVEVDAAPTVDLNRVLNETRSQYEA,   SEQ ID NO:5768
LRSPLGDRLNVEVDAAPTVDLNRVLNETRSQYEA,   SEQ ID NO:5769
LRCQLGDRLNVEVDTAPTVDLNRVLNETRSQYEA,   SEQ ID NO:5770
LRSQLGDRLNVEVDTAPTVDLNRVLNETRSQYEA,   SEQ ID NO:5771
LRCPLGDRLNVEVDTAPTVDLNRVLNETRSQYEA,   SEQ ID NO:5772
LRSPLGDRLNVEVDTAPTVDLNRVLNETRSQYEA,   SEQ ID NO:5773
LRCQLGDRLNVEVDAAPTVDLNQVLNETRNQYEA,   SEQ ID NO:5774
LRSQLGDRLNVEVDAAPTVDLNQVLNETRNQYEA,   SEQ ID NO:5775
LRCPLGDRLNVEVDAAPTVDLNQVLNETRNQYEA,   SEQ ID NO:5776
LRSPLGDRLNVEVDAAPTVDLNQVLNETRNQYEA,   SEQ ID NO:5777
LRCQLGDRLNVEVDTAPTVDLNQVLNETRNQYEA,   SEQ ID NO:5778
LRSQLGDRLNVEVDTAPTVDLNQVLNETRNQYEA,   SEQ ID NO:5779
LRCPLGDRLNVEVDTAPTVDLNQVLNETRNQYEA,   SEQ ID NO:5780
LRSPLGDRLNVEVDTAPTVDLNQVLNETRNQYEA,   SEQ ID NO:5781
LRCQLGDRLNVEVDAAPTVDLNRVLNETRNQYEA,   SEQ ID NO:5782
LRSQLGDRLNVEVDAAPTVDLNRVLNETRNQYEA,   SEQ ID NO:5783
LRCPLGDRLNVEVDAAPTVDLNRVLNETRNQYEA,   SEQ ID NO:5784
LRSPLGDRLNVEVDAAPTVDLNRVLNETRNQYEA,   SEQ ID NO:5785
LRCQLGDRLNVEVDTAPTVDLNRVLNETRNQYEA,   SEQ ID NO:5786
LRSQLGDRLNVEVDTAPTVDLNRVLNETRNQYEA,   SEQ ID NO:5787
LRCPLGDRLNVEVDTAPTVDLNRVLNETRNQYEA,   SEQ ID NO:5788
LRSPLGDRLNVEVDTAPTVDLNRVLNETRNQYEA,   SEQ ID NO:5789
RCQLGDRLNVEVDAAPTVDLNQVLNETRSQYEAL,   SEQ ID NO:5790
RSQLGDRLNVEVDAAPTVDLNQVLNETRSQYEAL,   SEQ ID NO:5791
RCPLGDRLNVEVDAAPTVDLNQVLNETRSQYEAL,   SEQ ID NO:5792
RSPLGDRLNVEVDAAPTVDLNQVLNETRSQYEAL,   SEQ ID NO:5793
RCQLGDRLNVEVDTAPTVDLNQVLNETRSQYEAL,   SEQ ID NO:5794
RSQLGDRLNVEVDTAPTVDLNQVLNETRSQYEAL,   SEQ ID NO:5795
RCPLGDRLNVEVDTAPTVDLNQVLNETRSQYEAL,   SEQ ID NO:5796
RSPLGDRLNVEVDTAPTVDLNQVLNETRSQYEAL,   SEQ ID NO:5797
RCQLGDRLNVEVDAAPTVDLNRVLNETRSQYEAL,   SEQ ID NO:5798
RSQLGDRLNVEVDAAPTVDLNRVLNETRSQYEAL,   SEQ ID NO:5799
RCPLGDRLNVEVDAAPTVDLNRVLNETRSQYEAL,   SEQ ID NO:5800
RSPLGDRLNVEVDAAPTVDLNRVLNETRSQYEAL,   SEQ ID NO:5801
RCQLGDRLNVEVDTAPTVDLNRVLNETRSQYEAL,   SEQ ID NO:5802
RSQLGDRLNVEVDTAPTVDLNRVLNETRSQYEAL,   SEQ ID NO:5803
RCPLGDRLNVEVDTAPTVDLNRVLNETRSQYEAL,   SEQ ID NO:5804
RSPLGDRLNVEVDTAPTVDLNRVLNETRSQYEAL,   SEQ ID NO:5805
RCQLGDRLNVEVDAAPTVDLNQVLNETRNQYEAL,   SEQ ID NO:5806
RSQLGDRLNVEVDAAPTVDLNQVLNETRNQYEAL,   SEQ ID NO:5807
RCPLGDRLNVEVDAAPTVDLNQVLNETRNQYEAL,   SEQ ID NO:5809
RSPLGDRLNVEVDAAPTVDLNQVLNETRNQYEAL,   SEQ ID NO:5810
RCQLGDRLNVEVDTAPTVDLNQVLNETRNQYEAL,   SEQ ID NO:5811
RSQLGDRLNVEVDTAPTVDLNQVLNETRNQYEAL,   SEQ ID NO:5812
RCPLGDRLNVEVDTAPTVDLNQVLNETRNQYEAL,   SEQ ID NO:5813
RSPLGDRLNVEVDTAPTVDLNQVLNETRNQYEAL,   SEQ ID NO:5814
RCQLGDRLNVEVDAAPTVDLNRVLNETRNQYEAL,   SEQ ID NO:5815
RSQLGDRLNVEVDAAPTVDLNRVLNETRNQYEAL,   SEQ ID NO:5816
RCPLGDRLNVEVDAAPTVDLNRVLNETRNQYEAL,   SEQ ID NO:5817
RSPLGDRLNVEVDAAPTVDLNRVLNETRNQYEAL,   SEQ ID NO:5818
RCQLGDRLNVEVDTAPTVDLNRVLNETRNQYEAL,   SEQ ID NO:5819
RSQLGDRLNVEVDTAPTVDLNRVLNETRNQYEAL,   SEQ ID NO:5820
RCPLGDRLNVEVDTAPTVDLNRVLNETRNQYEAL,   SEQ ID NO:5821
RSPLGDRLNVEVDTAPTVDLNRVLNETRNQYEAL,   SEQ ID NO:5822
EVNTLRCQLGDRLNVEVDAAPTVDLNQVLNETRSQ,  SEQ ID NO:5823
EVNTLRSQLGDRLNVEVDAAPTVDLNQVLNETRSQ,  SEQ ID NO:5824
EVNTLRCPLGDRLNVEVDAAPTVDLNQVLNETRSQ,  SEQ ID NO:5825
EVNTLRSPLGDRLNVEVDAAPTVDLNQVLNETRSQ,  SEQ ID NO:5826
EVNTLRCQLGDRLNVEVDTAPTVDLNQVLNETRSQ,  SEQ ID NO:5827
EVNTLRSQLGDRLNVEVDTAPTVDLNQVLNETRSQ,  SEQ ID NO:5828
EVNTLRCPLGDRLNVEVDTAPTVDLNQVLNETRSQ,  SEQ ID NO:5829
EVNTLRSPLGDRLNVEVDTAPTVDLNQVLNETRSQ,  SEQ ID NO:5830
EVNTLRCQLGDRLNVEVDAAPTVDLNRVLNETRSQ,  SEQ ID NO:5831
EVNTLRSQLGDRLNVEVDAAPTVDLNRVLNETRSQ,  SEQ ID NO:5832
EVNTLRCPLGDRLNVEVDAAPTVDLNRVLNETRSQ,  SEQ ID NO:5833
EVNTLRSPLGDRLNVEVDAAPTVDLNRVLNETRSQ,  SEQ ID NO:5834
EVNTLRCQLGDRLNVEVDTAPTVDLNRVLNETRSQ,  SEQ ID NO:5835
EVNTLRSQLGDRLNVEVDTAPTVDLNRVLNETRSQ,  SEQ ID NO:5836
EVNTLRCPLGDRLNVEVDTAPTVDLNRVLNETRSQ,  SEQ ID NO:5837
EVNTLRSPLGDRLNVEVDTAPTVDLNRVLNETRSQ,  SEQ ID NO:5838
EVNTLRCQLGDRLNVEVDAAPTVDLNQVLNETRNQ,  SEQ ID NO:5839
EVNTLRSQLGDRLNVEVDAAPTVDLNQVLNETRNQ,  SEQ ID NO:5840
EVNTLRCPLGDRLNVEVDAAPTVDLNQVLNETRNQ,  SEQ ID NO:5841
EVNTLRSPLGDRLNVEVDAAPTVDLNQVLNETRNQ,  SEQ ID NO:5842
EVNTLRCQLGDRLNVEVDTAPTVDLNQVLNETRNQ,  SEQ ID NO:5843
```

-continued

```
EVNTLRSQLGDRLNVEVDTAPTVDLNQVLNETRNQ,  SEQ ID NO:5844
EVNTLRCPLGDRLNVEVDTAPTVDLNQVLNETRNQ,  SEQ ID NO:5845
EVNTLRSPLGDRLNVEVDTAPTVDLNQVLNETRNQ,  SEQ ID NO:5846
EVNTLRCQLGDRLNVEVDAAPTVDLNRVLNETRNQ,  SEQ ID NO:5847
EVNTLRSQLGDRLNVEVDAAPTVDLNRVLNETRNQ,  SEQ ID NO:5848
EVNTLRCPLGDRLNVEVDAAPTVDLNRVLNETRNQ,  SEQ ID NO:5849
EVNTLRSPLGDRLNVEVDAAPTVDLNRVLNETRNQ,  SEQ ID NO:5850
EVNTLRCQLGDRLNVEVDTAPTVDLNRVLNETRNQ,  SEQ ID NO:5851
EVNTLRSQLGDRLNVEVDTAPTVDLNRVLNETRNQ,  SEQ ID NO:5852
EVNTLRCPLGDRLNVEVDTAPTVDLNRVLNETRNQ,  SEQ ID NO:5853
EVNTLRSPLGDRLNVEVDTAPTVDLNRVLNETRNQ,  SEQ ID NO:5854
VNTLRCQLGDRLNVEVDAAPTVDLNQVLNETRSQY,  SEQ ID NO:5855
VNTLRSQLGDRLNVEVDAAPTVDLNQVLNETRSQY,  SEQ ID NO:5856
VNTLRCPLGDRLNVEVDAAPTVDLNQVLNETRSQY,  SEQ ID NO:5857
VNTLRSPLGDRLNVEVDAAPTVDLNQVLNETRSQY,  SEQ ID NO:5858
VNTLRCQLGDRLNVEVDTAPTVDLNQVLNETRSQY,  SEQ ID NO:5859
VNTLRSQLGDRLNVEVDTAPTVDLNQVLNETRSQY,  SEQ ID NO:5860
VNTLRCPLGDRLNVEVDTAPTVDLNQVLNETRSQY,  SEQ ID NO:5861
VNTLRSPLGDRLNVEVDTAPTVDLNQVLNETRSQY,  SEQ ID NO:5862
VNTLRCQLGDRLNVEVDAAPTVDLNRVLNETRSQY,  SEQ ID NO:5863
VNTLRSQLGDRLNVEVDAAPTVDLNRVLNETRSQY,  SEQ ID NO:5864
VNTLRCPLGDRLNVEVDAAPTVDLNRVLNETRSQY,  SEQ ID NO:5865
VNTLRSPLGDRLNVEVDAAPTVDLNRVLNETRSQY,  SEQ ID NO:5866
VNTLRCQLGDRLNVEVDTAPTVDLNRVLNETRSQY,  SEQ ID NO:5867
VNTLRSQLGDRLNVEVDTAPTVDLNRVLNETRSQY,  SEQ ID NO:5868
VNTLRCPLGDRLNVEVDTAPTVDLNRVLNETRSQY,  SEQ ID NO:5869
VNTLRSPLGDRLNVEVDTAPTVDLNRVLNETRSQY,  SEQ ID NO:5870
VNTLRCQLGDRLNVEVDAAPTVDLNQVLNETRNQY,  SEQ ID NO:5871
VNTLRSQLGDRLNVEVDAAPTVDLNQVLNETRNQY,  SEQ ID NO:5872
VNTLRCPLGDRLNVEVDAAPTVDLNQVLNETRNQY,  SEQ ID NO:5873
VNTLRSPLGDRLNVEVDAAPTVDLNQVLNETRNQY,  SEQ ID NO:5874
VNTLRCQLGDRLNVEVDTAPTVDLNQVLNETRNQY,  SEQ ID NO:5875
VNTLRSQLGDRLNVEVDTAPTVDLNQVLNETRNQY,  SEQ ID NO:5876
VNTLRCPLGDRLNVEVDTAPTVDLNQVLNETRNQY,  SEQ ID NO:5877
VNTLRSPLGDRLNVEVDTAPTVDLNQVLNETRNQY,  SEQ ID NO:5878
VNTLRCQLGDRLNVEVDAAPTVDLNRVLNETRNQY,  SEQ ID NO:5879
VNTLRSQLGDRLNVEVDAAPTVDLNRVLNETRNQY,  SEQ ID NO:5880
VNTLRCPLGDRLNVEVDAAPTVDLNRVLNETRNQY,  SEQ ID NO:5881
VNTLRSPLGDRLNVEVDAAPTVDLNRVLNETRNQY,  SEQ ID NO:5882
VNTLRCQLGDRLNVEVDTAPTVDLNRVLNETRNQY,  SEQ ID NO:5883
VNTLRSQLGDRLNVEVDTAPTVDLNRVLNETRNQY,  SEQ ID NO:5884
VNTLRCPLGDRLNVEVDTAPTVDLNRVLNETRNQY,  SEQ ID NO:5885
VNTLRSPLGDRLNVEVDTAPTVDLNRVLNETRNQY,  SEQ ID NO:5886
NTLRCQLGDRLNVEVDAAPTVDLNQVLNETRSQYE,  SEQ ID NO:5887
NTLRSQLGDRLNVEVDAAPTVDLNQVLNETRSQYE,  SEQ ID NO:5888
NTLRCPLGDRLNVEVDAAPTVDLNQVLNETRSQYE,  SEQ ID NO:5889
NTLRSPLGDRLNVEVDAAPTVDLNQVLNETRSQYE,  SEQ ID NO:5890
NTLRCQLGDRLNVEVDTAPTVDLNQVLNETRSQYE,  SEQ ID NO:5891
NTLRSQLGDRLNVEVDTAPTVDLNQVLNETRSQYE,  SEQ ID NO:5892
NTLRCPLGDRLNVEVDTAPTVDLNQVLNETRSQYE,  SEQ ID NO:5893
NTLRSPLGDRLNVEVDTAPTVDLNQVLNETRSQYE,  SEQ ID NO:5894
NTLRCQLGDRLNVEVDAAPTVDLNRVLNETRSQYE,  SEQ ID NO:5895
NTLRSQLGDRLNVEVDAAPTVDLNRVLNETRSQYE,  SEQ ID NO:5896
NTLRCPLGDRLNVEVDAAPTVDLNRVLNETRSQYE,  SEQ ID NO:5897
NTLRSPLGDRLNVEVDAAPTVDLNRVLNETRSQYE,  SEQ ID NO:5898
NTLRCQLGDRLNVEVDTAPTVDLNRVLNETRSQYE,  SEQ ID NO:5899
NTLRSQLGDRLNVEVDTAPTVDLNRVLNETRSQYE,  SEQ ID NO:5900
NTLRCPLGDRLNVEVDTAPTVDLNRVLNETRSQYE,  SEQ ID NO:5901
NTLRSPLGDRLNVEVDTAPTVDLNRVLNETRSQYE,  SEQ ID NO:5902
NTLRCQLGDRLNVEVDAAPTVDLNQVLNETRNQYE,  SEQ ID NO:5903
NTLRSQLGDRLNVEVDAAPTVDLNQVLNETRNQYE,  SEQ ID NO:5904
NTLRCPLGDRLNVEVDAAPTVDLNQVLNETRNQYE,  SEQ ID NO:5905
NTLRSPLGDRLNVEVDAAPTVDLNQVLNETRNQYE,  SEQ ID NO:5906
NTLRCQLGDRLNVEVDTAPTVDLNQVLNETRNQYE,  SEQ ID NO:5907
NTLRSQLGDRLNVEVDTAPTVDLNQVLNETRNQYE,  SEQ ID NO:5908
NTLRCPLGDRLNVEVDTAPTVDLNQVLNETRNQYE,  SEQ ID NO:5909
NTLRSPLGDRLNVEVDTAPTVDLNQVLNETRNQYE,  SEQ ID NO:5910
NTLRCQLGDRLNVEVDAAPTVDLNRVLNETRNQYE,  SEQ ID NO:5911
NTLRSQLGDRLNVEVDAAPTVDLNRVLNETRNQYE,  SEQ ID NO:5912
NTLRCPLGDRLNVEVDAAPTVDLNRVLNETRNQYE,  SEQ ID NO:5913
NTLRSPLGDRLNVEVDAAPTVDLNRVLNETRNQYE,  SEQ ID NO:5914
NTLRCQLGDRLNVEVDTAPTVDLNRVLNETRNQYE,  SEQ ID NO:5915
NTLRSQLGDRLNVEVDTAPTVDLNRVLNETRNQYE,  SEQ ID NO:5916
NTLRCPLGDRLNVEVDTAPTVDLNRVLNETRNQYE,  SEQ ID NO:5917
NTLRSPLGDRLNVEVDTAPTVDLNRVLNETRNQYE,  SEQ ID NO:5918
TLRCQLGDRLNVEVDAAPTVDLNQVLNETRSQYEA,  SEQ ID NO:5919
TLRSQLGDRLNVEVDAAPTVDLNQVLNETRSQYEA,  SEQ ID NO:5920
TLRCPLGDRLNVEVDAAPTVDLNQVLNETRSQYEA,  SEQ ID NO:5921
TLRSPLGDRLNVEVDAAPTVDLNQVLNETRSQYEA,  SEQ ID NO:5922
TLRCQLGDRLNVEVDTAPTVDLNQVLNETRSQYEA,  SEQ ID NO:5923
```

-continued

```
TLRSQLGDRLNVEVDTAPTVDLNQVLNETRSQYEA, SEQ ID NO:5924
TLRCPLGDRLNVEVDTAPTVDLNQVLNETRSQYEA, SEQ ID NO:5925
TLRSPLGDRLNVEVDTAPTVDLNQVLNETRSQYEA, SEQ ID NO:5926
TLRCQLGDRLNVEVDAAPTVDLNRVLNETRSQYEA, SEQ ID NO:5927
TLRSQLGDRLNVEVDAAPTVDLNRVLNETRSQYEA, SEQ ID NO:5958
TLRCPLGDRLNVEVDAAPTVDLNRVLNETRSQYEA, SEQ ID NO:5929
TLRSPLGDRLNVEVDAAPTVDLNRVLNETRSQYEA, SEQ ID NO:5930
TLRCQLGDRLNVEVDTAPTVDLNRVLNETRSQYEA, SEQ ID NO:5931
TLRSQLGDRLNVEVDTAPTVDLNRVLNETRSQYEA, SEQ ID NO:5932
TLRCPLGDRLNVEVDTAPTVDLNRVLNETRSQYEA, SEQ ID NO:5933
TLRSPLGDRLNVEVDTAPTVDLNRVLNETRSQYEA, SEQ ID NO:5934
TLRCQLGDRLNVEVDAAPTVDLNQVLNETRNQYEA, SEQ ID NO:5935
TLRSQLGDRLNVEVDAAPTVDLNQVLNETRNQYEA, SEQ ID NO:5936
TLRCPLGDRLNVEVDAAPTVDLNQVLNETRNQYEA, SEQ ID NO:5937
TLRSPLGDRLNVEVDAAPTVDLNQVLNETRNQYEA, SEQ ID NO:5938
TLRCQLGDRLNVEVDTAPTVDLNQVLNETRNQYEA, SEQ ID NO:5938
TLRSQLGDRLNVEVDTAPTVDLNQVLNETRNQYEA, SEQ ID NO:5940
TLRCPLGDRLNVEVDTAPTVDLNQVLNETRNQYEA, SEQ ID NO:5941
TLRSPLGDRLNVEVDTAPTVDLNQVLNETRNQYEA, SEQ ID NO:5942
TLRCQLGDRLNVEVDAAPTVDLNRVLNETRNQYEA, SEQ ID NO:5943
TLRSQLGDRLNVEVDAAPTVDLNRVLNETRNQYEA, SEQ ID NO:5944
TLRCPLGDRLNVEVDAAPTVDLNRVLNETRNQYEA, SEQ ID NO:5945
TLRSPLGDRLNVEVDAAPTVDLNRVLNETRNQYEA, SEQ ID NO:5946
TLRCQLGDRLNVEVDTAPTVDLNRVLNETRNQYEA, SEQ ID NO:5947
TLRSQLGDRLNVEVDTAPTVDLNRVLNETRNQYEA, SEQ ID NO:5948
TLRCPLGDRLNVEVDTAPTVDLNRVLNETRNQYEA, SEQ ID NO:5949
TLRSPLGDRLNVEVDTAPTVDLNRVLNETRNQYEA, SEQ ID NO:5950
LRCQLGDRLNVEVDAAPTVDLNQVLNETRSQYEAL, SEQ ID NO:5951
LRSQLGDRLNVEVDAAPTVDLNQVLNETRSQYEAL, SEQ ID NO:5952
LRCPLGDRLNVEVDAAPTVDLNQVLNETRSQYEAL, SEQ ID NO:5953
LRSPLGDRLNVEVDAAPTVDLNQVLNETRSQYEAL, SEQ ID NO:5954
LRCQLGDRLNVEVDTAPTVDLNQVLNETRSQYEAL, SEQ ID NO:5955
LRSQLGDRLNVEVDTAPTVDLNQVLNETRSQYEAL, SEQ ID NO:5956
LRCPLGDRLNVEVDTAPTVDLNQVLNETRSQYEAL, SEQ ID NO:5957
LRSPLGDRLNVEVDTAPTVDLNQVLNETRSQYEAL, SEQ ID NO:5958
LRCQLGDRLNVEVDAAPTVDLNRVLNETRSQYEAL, SEQ ID NO:5959
LRSQLGDRLNVEVDAAPTVDLNRVLNETRSQYEAL, SEQ ID NO:5960
LRCPLGDRLNVEVDAAPTVDLNRVLNETRSQYEAL, SEQ ID NO:5961
LRSPLGDRLNVEVDAAPTVDLNRVLNETRSQYEAL, SEQ ID NO:5962
LRCQLGDRLNVEVDTAPTVDLNRVLNETRSQYEAL, SEQ ID NO:5963
LRSQLGDRLNVEVDTAPTVDLNRVLNETRSQYEAL, SEQ ID NO:5964
LRCPLGDRLNVEVDTAPTVDLNRVLNETRSQYEAL, SEQ ID NO:5965
LRSPLGDRLNVEVDTAPTVDLNRVLNETRSQYEAL, SEQ ID NO:5966
LRCQLGDRLNVEVDAAPTVDLNQVLNETRNQYEAL, SEQ ID NO:5967
LRSQLGDRLNVEVDAAPTVDLNQVLNETRNQYEAL, SEQ ID NO:5968
LRCPLGDRLNVEVDAAPTVDLNQVLNETRNQYEAL, SEQ ID NO:5969
LRSPLGDRLNVEVDAAPTVDLNQVLNETRNQYEAL, SEQ ID NO:5970
LRCQLGDRLNVEVDTAPTVDLNQVLNETRNQYEAL, SEQ ID NO:5971
LRSQLGDRLNVEVDTAPTVDLNQVLNETRNQYEAL, SEQ ID NO:5972
LRCPLGDRLNVEVDTAPTVDLNQVLNETRNQYEAL, SEQ ID NO:5973
LRSPLGDRLNVEVDTAPTVDLNQVLNETRNQYEAL, SEQ ID NO:5974
LRCQLGDRLNVEVDAAPTVDLNRVLNETRNQYEAL, SEQ ID NO:5975
LRSQLGDRLNVEVDAAPTVDLNRVLNETRNQYEAL, SEQ ID NO:5976
LRCPLGDRLNVEVDAAPTVDLNRVLNETRNQYEAL, SEQ ID NO:5977
LRSPLGDRLNVEVDAAPTVDLNRVLNETRNQYEAL, SEQ ID NO:5978
LRCQLGDRLNVEVDTAPTVDLNRVLNETRNQYEAL, SEQ ID NO:5979
LRSQLGDRLNVEVDTAPTVDLNRVLNETRNQYEAL, SEQ ID NO:5980
LRCPLGDRLNVEVDTAPTVDLNRVLNETRNQYEAL, SEQ ID NO:5981
LRSPLGDRLNVEVDTAPTVDLNRVLNETRNQYEAL, SEQ ID NO:5982
EVNTLRCQLGDRLNVEVDAAPTVDLNQVLNETRSQY, SEQ ID NO:5983
EVNTLRSQLGDRLNVEVDAAPTVDLNQVLNETRSQY, SEQ ID NO:5984
EVNTLRCPLGDRLNVEVDAAPTVDLNQVLNETRSQY, SEQ ID NO:5985
EVNTLRSPLGDRLNVEVDAAPTVDLNQVLNETRSQY, SEQ ID NO:5986
EVNTLRCQLGDRLNVEVDTAPTVDLNQVLNETRSQY, SEQ ID NO:5987
EVNTLRSQLGDRLNVEVDTAPTVDLNQVLNETRSQY, SEQ ID NO:5988
EVNTLRCPLGDRLNVEVDTAPTVDLNQVLNETRSQY, SEQ ID NO:5989
EVNTLRSPLGDRLNVEVDTAPTVDLNQVLNETRSQY, SEQ ID NO:5990
EVNTLRCQLGDRLNVEVDAAPTVDLNRVLNETRSQY, SEQ ID NO:5991
EVNTLRSQLGDRLNVEVDAAPTVDLNRVLNETRSQY, SEQ ID NO:5992
EVNTLRCPLGDRLNVEVDAAPTVDLNRVLNETRSQY, SEQ ID NO:5993
EVNTLRSPLGDRLNVEVDAAPTVDLNRVLNETRSQY, SEQ ID NO:5994
EVNTLRCQLGDRLNVEVDTAPTVDLNRVLNETRSQY, SEQ ID NO:5995
EVNTLRSQLGDRLNVEVDTAPTVDLNRVLNETRSQY, SEQ ID NO:5996
EVNTLRCPLGDRLNVEVDTAPTVDLNRVLNETRSQY, SEQ ID NO:5997
EVNTLRSPLGDRLNVEVDTAPTVDLNRVLNETRSQY, SEQ ID NO:5998
EVNTLRCQLGDRLNVEVDAAPTVDLNQVLNETRNQY, SEQ ID NO:5999
EVNTLRSQLGDRLNVEVDAAPTVDLNQVLNETRNQY, SEQ ID NO:6000
EVNTLRCPLGDRLNVEVDAAPTVDLNQVLNETRNQY, SEQ ID NO:6001
EVNTLRSPLGDRLNVEVDAAPTVDLNQVLNETRNQY, SEQ ID NO:6002
EVNTLRCQLGDRLNVEVDTAPTVDLNQVLNETRNQY, SEQ ID NO:6003
```

-continued

```
EVNTLRSQLGDRLNVEVDTAPTVDLNQVLNETRNQY, SEQ ID NO:6004
EVNTLRCPLGDRLNVEVDTAPTVDLNQVLNETRNQY, SEQ ID NO:6005
EVNTLRSPLGDRLNVEVDTAPTVDLNQVLNETRNQY, SEQ ID NO:6006
EVNTLRCQLGDRLNVEVDAAPTVDLNRVLNETRNQY, SEQ ID NO:6007
EVNTLRSQLGDRLNVEVDAAPTVDLNRVLNETRNQY, SEQ ID NO:6008
EVNTLRCPLGDRLNVEVDAAPTVDLNRVLNETRNQY, SEQ ID NO:6009
EVNTLRSPLGDRLNVEVDAAPTVDLNRVLNETRNQY, SEQ ID NO:6010
EVNTLRCQLGDRLNVEVDTAPTVDLNRVLNETRNQY, SEQ ID NO:6011
EVNTLRSQLGDRLNVEVDTAPTVDLNRVLNETRNQY, SEQ ID NO:6012
EVNTLRCPLGDRLNVEVDTAPTVDLNRVLNETRNQY, SEQ ID NO:6013
EVNTLRSPLGDRLNVEVDTAPTVDLNRVLNETRNQY, SEQ ID NO:6014
VNTLRCQLGDRLNVEVDAAPTVDLNQVLNETRSQYE, SEQ ID NO:6015
VNTLRSQLGDRLNVEVDAAPTVDLNQVLNETRSQYE, SEQ ID NO:6016
VNTLRCPLGDRLNVEVDAAPTVDLNQVLNETRSQYE, SEQ ID NO:6017
VNTLRSPLGDRLNVEVDAAPTVDLNQVLNETRSQYE, SEQ ID NO:6018
VNTLRCQLGDRLNVEVDTAPTVDLNQVLNETRSQYE, SEQ ID NO:6019
VNTLRSQLGDRLNVEVDTAPTVDLNQVLNETRSQYE, SEQ ID NO:6020
VNTLRCPLGDRLNVEVDTAPTVDLNQVLNETRSQYE, SEQ ID NO:6021
VNTLRSPLGDRLNVEVDTAPTVDLNQVLNETRSQYE, SEQ ID NO:6022
VNTLRCQLGDRLNVEVDAAPTVDLNRVLNETRSQYE, SEQ ID NO:6023
VNTLRSQLGDRLNVEVDAAPTVDLNRVLNETRSQYE, SEQ ID NO:6024
VNTLRCPLGDRLNVEVDAAPTVDLNRVLNETRSQYE, SEQ ID NO:6025
VNTLRSPLGDRLNVEVDAAPTVDLNRVLNETRSQYE, SEQ ID NO:6026
VNTLRCQLGDRLNVEVDTAPTVDLNRVLNETRSQYE, SEQ ID NO:6027
VNTLRSQLGDRLNVEVDTAPTVDLNRVLNETRSQYE, SEQ ID NO:6028
VNTLRCPLGDRLNVEVDTAPTVDLNRVLNETRSQYE, SEQ ID NO:6029
VNTLRSPLGDRLNVEVDTAPTVDLNRVLNETRSQYE, SEQ ID NO:6030
VNTLRCQLGDRLNVEVDAAPTVDLNQVLNETRNQYE, SEQ ID NO:6031
VNTLRSQLGDRLNVEVDAAPTVDLNQVLNETRNQYE, SEQ ID NO:6032
VNTLRCPLGDRLNVEVDAAPTVDLNQVLNETRNQYE, SEQ ID NO:6033
VNTLRSPLGDRLNVEVDAAPTVDLNQVLNETRNQYE, SEQ ID NO:6034
VNTLRCQLGDRLNVEVDTAPTVDLNQVLNETRNQYE, SEQ ID NO:6035
VNTLRSQLGDRLNVEVDTAPTVDLNQVLNETRNQYE, SEQ ID NO:6036
VNTLRCPLGDRLNVEVDTAPTVDLNQVLNETRNQYE, SEQ ID NO:6037
VNTLRSPLGDRLNVEVDTAPTVDLNQVLNETRNQYE, SEQ ID NO:6038
VNTLRCQLGDRLNVEVDAAPTVDLNRVLNETRNQYE, SEQ ID NO:6039
VNTLRSQLGDRLNVEVDAAPTVDLNRVLNETRNQYE, SEQ ID NO:6040
VNTLRCPLGDRLNVEVDAAPTVDLNRVLNETRNQYE, SEQ ID NO:6041
VNTLRSPLGDRLNVEVDAAPTVDLNRVLNETRNQYE, SEQ ID NO:6042
VNTLRCQLGDRLNVEVDTAPTVDLNRVLNETRNQYE, SEQ ID NO:6043
VNTLRSQLGDRLNVEVDTAPTVDLNRVLNETRNQYE, SEQ ID NO:6044
VNTLRCPLGDRLNVEVDTAPTVDLNRVLNETRNQYE, SEQ ID NO:6045
VNTLRSPLGDRLNVEVDTAPTVDLNRVLNETRNQYE, SEQ ID NO:6046
NTLRCQLGDRLNVEVDAAPTVDLNQVLNETRSQYEA, SEQ ID NO:6047
NTLRSQLGDRLNVEVDAAPTVDLNQVLNETRSQYEA, SEQ ID NO:6048
NTLRCPLGDRLNVEVDAAPTVDLNQVLNETRSQYEA, SEQ ID NO:6049
NTLRSPLGDRLNVEVDAAPTVDLNQVLNETRSQYEA, SEQ ID NO:6050
NTLRCQLGDRLNVEVDTAPTVDLNQVLNETRSQYEA, SEQ ID NO:6051
NTLRSQLGDRLNVEVDTAPTVDLNQVLNETRSQYEA, SEQ ID NO:6052
NTLRCPLGDRLNVEVDTAPTVDLNQVLNETRSQYEA, SEQ ID NO:6053
NTLRSPLGDRLNVEVDTAPTVDLNQVLNETRSQYEA, SEQ ID NO:6054
NTLRCQLGDRLNVEVDAAPTVDLNRVLNETRSQYEA, SEQ ID NO:6055
NTLRSQLGDRLNVEVDAAPTVDLNRVLNETRSQYEA, SEQ ID NO:6056
NTLRCPLGDRLNVEVDAAPTVDLNRVLNETRSQYEA, SEQ ID NO:6057
NTLRSPLGDRLNVEVDAAPTVDLNRVLNETRSQYEA, SEQ ID NO:6058
NTLRCQLGDRLNVEVDTAPTVDLNRVLNETRSQYEA, SEQ ID NO:6059
NTLRSQLGDRLNVEVDTAPTVDLNRVLNETRSQYEA, SEQ ID NO:6060
NTLRCPLGDRLNVEVDTAPTVDLNRVLNETRSQYEA, SEQ ID NO:6061
NTLRSPLGDRLNVEVDTAPTVDLNRVLNETRSQYEA, SEQ ID NO:6062
NTLRCQLGDRLNVEVDAAPTVDLNQVLNETRNQYEA, SEQ ID NO:6063
NTLRSQLGDRLNVEVDAAPTVDLNQVLNETRNQYEA, SEQ ID NO:6064
NTLRCPLGDRLNVEVDAAPTVDLNQVLNETRNQYEA, SEQ ID NO:6065
NTLRSPLGDRLNVEVDAAPTVDLNQVLNETRNQYEA, SEQ ID NO:6066
NTLRCQLGDRLNVEVDTAPTVDLNQVLNETRNQYEA, SEQ ID NO:6067
NTLRSQLGDRLNVEVDTAPTVDLNQVLNETRNQYEA, SEQ ID NO:6068
NTLRCPLGDRLNVEVDTAPTVDLNQVLNETRNQYEA, SEQ ID NO:6069
NTLRSPLGDRLNVEVDTAPTVDLNQVLNETRNQYEA, SEQ ID NO:6070
NTLRCQLGDRLNVEVDAAPTVDLNRVLNETRNQYEA, SEQ ID NO:6071
NTLRSQLGDRLNVEVDAAPTVDLNRVLNETRNQYEA, SEQ ID NO:6072
NTLRCPLGDRLNVEVDAAPTVDLNRVLNETRNQYEA, SEQ ID NO:6073
NTLRSPLGDRLNVEVDAAPTVDLNRVLNETRNQYEA, SEQ ID NO:6074
NTLRCQLGDRLNVEVDTAPTVDLNRVLNETRNQYEA, SEQ ID NO:6075
NTLRSQLGDRLNVEVDTAPTVDLNRVLNETRNQYEA, SEQ ID NO:6076
NTLRCPLGDRLNVEVDTAPTVDLNRVLNETRNQYEA, SEQ ID NO:6077
NTLRSPLGDRLNVEVDTAPTVDLNRVLNETRNQYEA, SEQ ID NO:6078
TLRCQLGDRLNVEVDAAPTVDLNQVLNETRSQYEAL, SEQ ID NO:6079
TLRSQLGDRLNVEVDAAPTVDLNQVLNETRSQYEAL, SEQ ID NO:6080
TLRCPLGDRLNVEVDAAPTVDLNQVLNETRSQYEAL, SEQ ID NO:6081
TLRSPLGDRLNVEVDAAPTVDLNQVLNETRSQYEAL, SEQ ID NO:6082
TLRCQLGDRLNVEVDTAPTVDLNQVLNETRSQYEAL, SEQ ID NO:6083
```

-continued

```
TLRSQLGDRLNVEVDTAPTVDLNQVLNETRSQYEAL,  SEQ ID NO:6084
TLRCPLGDRLNVEVDTAPTVDLNQVLNETRSQYEAL,  SEQ ID NO:6085
TLRSPLGDRLNVEVDTAPTVDLNQVLNETRSQYEAL,  SEQ ID NO:6086
TLRCQLGDRLNVEVDAAPTVDLNRVLNETRSQYEAL,  SEQ ID NO:6087
TLRSQLGDRLNVEVDAAPTVDLNRVLNETRSQYEAL,  SEQ ID NO:6088
TLRCPLGDRLNVEVDAAPTVDLNRVLNETRSQYEAL,  SEQ ID NO:6089
TLRSPLGDRLNVEVDAAPTVDLNRVLNETRSQYEAL,  SEQ ID NO:6090
TLRCQLGDRLNVEVDTAPTVDLNRVLNETRSQYEAL,  SEQ ID NO:6091
TLRSQLGDRLNVEVDTAPTVDLNRVLNETRSQYEAL,  SEQ ID NO:6092
TLRCPLGDRLNVEVDTAPTVDLNRVLNETRSQYEAL,  SEQ ID NO:6093
TLRSPLGDRLNVEVDTAPTVDLNRVLNETRSQYEAL,  SEQ ID NO:6094
TLRCQLGDRLNVEVDAAPTVDLNQVLNETRNQYEAL,  SEQ ID NO:6095
TLRSQLGDRLNVEVDAAPTVDLNQVLNETRNQYEAL,  SEQ ID NO:6096
TLRCPLGDRLNVEVDAAPTVDLNQVLNETRNQYEAL,  SEQ ID NO:6097
TLRSPLGDRLNVEVDAAPTVDLNQVLNETRNQYEAL,  SEQ ID NO:6098
TLRCQLGDRLNVEVDTAPTVDLNQVLNETRNQYEAL,  SEQ ID NO:6099
TLRSQLGDRLNVEVDTAPTVDLNQVLNETRNQYEAL,  SEQ ID NO:6100
TLRCPLGDRLNVEVDTAPTVDLNQVLNETRNQYEAL,  SEQ ID NO:6101
TLRSPLGDRLNVEVDTAPTVDLNQVLNETRNQYEAL,  SEQ ID NO:6102
TLRCQLGDRLNVEVDAAPTVDLNRVLNETRNQYEAL,  SEQ ID NO:6103
TLRSQLGDRLNVEVDAAPTVDLNRVLNETRNQYEAL,  SEQ ID NO:6104
TLRCPLGDRLNVEVDAAPTVDLNRVLNETRNQYEAL,  SEQ ID NO:6105
TLRSPLGDRLNVEVDAAPTVDLNRVLNETRNQYEAL,  SEQ ID NO:6106
TLRCQLGDRLNVEVDTAPTVDLNRVLNETRNQYEAL,  SEQ ID NO:6107
TLRSQLGDRLNVEVDTAPTVDLNRVLNETRNQYEAL,  SEQ ID NO:6108
TLRCPLGDRLNVEVDTAPTVDLNRVLNETRNQYEAL,  SEQ ID NO:6109
TLRSPLGDRLNVEVDTAPTVDLNRVLNETRNQYEAL,  SEQ ID NO:6110
EVNTLRCQLGDRLNVEVDAAPTVDLNQVLNETRSQYE,  SEQ ID NO:6111
EVNTLRSQLGDRLNVEVDAAPTVDLNQVLNETRSQYE,  SEQ ID NO:6112
EVNTLRCPLGDRLNVEVDAAPTVDLNQVLNETRSQYE,  SEQ ID NO:6113
EVNTLRSPLGDRLNVEVDAAPTVDLNQVLNETRSQYE,  SEQ ID NO:6114
EVNTLRCQLGDRLNVEVDTAPTVDLNQVLNETRSQYE,  SEQ ID NO:6115
EVNTLRSQLGDRLNVEVDTAPTVDLNQVLNETRSQYE,  SEQ ID NO:6116
EVNTLRCPLGDRLNVEVDTAPTVDLNQVLNETRSQYE,  SEQ ID NO:6117
EVNTLRSPLGDRLNVEVDTAPTVDLNQVLNETRSQYE,  SEQ ID NO:6118
EVNTLRCQLGDRLNVEVDAAPTVDLNRVLNETRSQYE,  SEQ ID NO:6119
EVNTLRSQLGDRLNVEVDAAPTVDLNRVLNETRSQYE,  SEQ ID NO:6120
EVNTLRCPLGDRLNVEVDAAPTVDLNRVLNETRSQYE,  SEQ ID NO:6121
EVNTLRSPLGDRLNVEVDAAPTVDLNRVLNETRSQYE,  SEQ ID NO:6122
EVNTLRCQLGDRLNVEVDTAPTVDLNRVLNETRSQYE,  SEQ ID NO:6123
EVNTLRSQLGDRLNVEVDTAPTVDLNRVLNETRSQYE,  SEQ ID NO:6124
EVNTLRCPLGDRLNVEVDTAPTVDLNRVLNETRSQYE,  SEQ ID NO:6125
EVNTLRSPLGDRLNVEVDTAPTVDLNRVLNETRSQYE,  SEQ ID NO:6126
EVNTLRCQLGDRLNVEVDAAPTVDLNQVLNETRNQYE,  SEQ ID NO:6127
EVNTLRSQLGDRLNVEVDAAPTVDLNQVLNETRNQYE,  SEQ ID NO:6128
EVNTLRCPLGDRLNVEVDAAPTVDLNQVLNETRNQYE,  SEQ ID NO:6129
EVNTLRSPLGDRLNVEVDAAPTVDLNQVLNETRNQYE,  SEQ ID NO:6130
EVNTLRCQLGDRLNVEVDTAPTVDLNQVLNETRNQYE,  SEQ ID NO:6131
EVNTLRSQLGDRLNVEVDTAPTVDLNQVLNETRNQYE,  SEQ ID NO:6132
EVNTLRCPLGDRLNVEVDTAPTVDLNQVLNETRNQYE,  SEQ ID NO:6133
EVNTLRSPLGDRLNVEVDTAPTVDLNQVLNETRNQYE,  SEQ ID NO:6134
EVNTLRCQLGDRLNVEVDAAPTVDLNRVLNETRNQYE,  SEQ ID NO:6135
EVNTLRSQLGDRLNVEVDAAPTVDLNRVLNETRNQYE,  SEQ ID NO:6136
EVNTLRCPLGDRLNVEVDAAPTVDLNRVLNETRNQYE,  SEQ ID NO:6137
EVNTLRSPLGDRLNVEVDAAPTVDLNRVLNETRNQYE,  SEQ ID NO:6138
EVNTLRCQLGDRLNVEVDTAPTVDLNRVLNETRNQYE,  SEQ ID NO:6139
EVNTLRSQLGDRLNVEVDTAPTVDLNRVLNETRNQYE,  SEQ ID NO:6140
EVNTLRCPLGDRLNVEVDTAPTVDLNRVLNETRNQYE,  SEQ ID NO:6141
EVNTLRSPLGDRLNVEVDTAPTVDLNRVLNETRNQYE,  SEQ ID NO:6142
VNTLRCQLGDRLNVEVDAAPTVDLNQVLNETRSQYEA,  SEQ ID NO:6143
VNTLRSQLGDRLNVEVDAAPTVDLNQVLNETRSQYEA,  SEQ ID NO:6144
VNTLRCPLGDRLNVEVDAAPTVDLNQVLNETRSQYEA,  SEQ ID NO:6145
VNTLRSPLGDRLNVEVDAAPTVDLNQVLNETRSQYEA,  SEQ ID NO:6146
VNTLRCQLGDRLNVEVDTAPTVDLNQVLNETRSQYEA,  SEQ ID NO:6147
VNTLRSQLGDRLNVEVDTAPTVDLNQVLNETRSQYEA,  SEQ ID NO:6148
VNTLRCPLGDRLNVEVDTAPTVDLNQVLNETRSQYEA,  SEQ ID NO:6149
VNTLRSPLGDRLNVEVDTAPTVDLNQVLNETRSQYEA,  SEQ ID NO:6150
VNTLRCQLGDRLNVEVDAAPTVDLNRVLNETRSQYEA,  SEQ ID NO:6151
VNTLRSQLGDRLNVEVDAAPTVDLNRVLNETRSQYEA,  SEQ ID NO:6152
VNTLRCPLGDRLNVEVDAAPTVDLNRVLNETRSQYEA,  SEQ ID NO:6153
VNTLRSPLGDRLNVEVDAAPTVDLNRVLNETRSQYEA,  SEQ ID NO:6154
VNTLRCQLGDRLNVEVDTAPTVDLNRVLNETRSQYEA,  SEQ ID NO:6155
VNTLRSQLGDRLNVEVDTAPTVDLNRVLNETRSQYEA,  SEQ ID NO:6156
VNTLRCPLGDRLNVEVDTAPTVDLNRVLNETRSQYEA,  SEQ ID NO:6157
VNTLRSPLGDRLNVEVDTAPTVDLNRVLNETRSQYEA,  SEQ ID NO:6158
```

-continued

```
VNTLRCQLGDRLNVEVDAAPTVDLNQVLNETRNQYEA,   SEQ ID NO:6159
VNTLRSQLGDRLNVEVDAAPTVDLNQVLNETRNQYEA,   SEQ ID NO:6160
VNTLRCPLGDRLNVEVDAAPTVDLNQVLNETRNQYEA,   SEQ ID NO:6161
VNTLRSPLGDRLNVEVDAAPTVDLNQVLNETRNQYEA,   SEQ ID NO:6162
VNTLRCQLGDRLNVEVDTAPTVDLNQVLNETRNQYEA,   SEQ ID NO:6163
VNTLRSQLGDRLNVEVDTAPTVDLNQVLNETRNQYEA,   SEQ ID NO:6164
VNTLRCPLGDRLNVEVDTAPTVDLNQVLNETRNQYEA,   SEQ ID NO:6165
VNTLRSPLGDRLNVEVDTAPTVDLNQVLNETRNQYEA,   SEQ ID NO:6166
VNTLRCQLGDRLNVEVDAAPTVDLNRVLNETRNQYEA,   SEQ ID NO:6167
VNTLRSQLGDRLNVEVDAAPTVDLNRVLNETRNQYEA,   SEQ ID NO:6168
VNTLRCPLGDRLNVEVDAAPTVDLNRVLNETRNQYEA,   SEQ ID NO:6169
VNTLRSPLGDRLNVEVDAAPTVDLNRVLNETRNQYEA,   SEQ ID NO:6170
VNTLRCQLGDRLNVEVDTAPTVDLNRVLNETRNQYEA,   SEQ ID NO:6171
VNTLRSQLGDRLNVEVDTAPTVDLNRVLNETRNQYEA,   SEQ ID NO:6172
VNTLRCPLGDRLNVEVDTAPTVDLNRVLNETRNQYEA,   SEQ ID NO:6173
VNTLRSPLGDRLNVEVDTAPTVDLNRVLNETRNQYEA,   SEQ ID NO:6174
NTLRCQLGDRLNVEVDAAPTVDLNQVLNETRSQYEAL,   SEQ ID NO:6175
NTLRSQLGDRLNVEVDAAPTVDLNQVLNETRSQYEAL,   SEQ ID NO:6176
NTLRCPLGDRLNVEVDAAPTVDLNQVLNETRSQYEAL,   SEQ ID NO:6177
NTLRSPLGDRLNVEVDAAPTVDLNQVLNETRSQYEAL,   SEQ ID NO:6178
NTLRCQLGDRLNVEVDTAPTVDLNQVLNETRSQYEAL,   SEQ ID NO:6179
NTLRSQLGDRLNVEVDTAPTVDLNQVLNETRSQYEAL,   SEQ ID NO:6180
NTLRCPLGDRLNVEVDTAPTVDLNQVLNETRSQYEAL,   SEQ ID NO:6181
NTLRSPLGDRLNVEVDTAPTVDLNQVLNETRSQYEAL,   SEQ ID NO:6182
NTLRCQLGDRLNVEVDAAPTVDLNRVLNETRSQYEAL,   SEQ ID NO:6183
NTLRSQLGDRLNVEVDAAPTVDLNRVLNETRSQYEAL,   SEQ ID NO:6184
NTLRCPLGDRLNVEVDAAPTVDLNRVLNETRSQYEAL,   SEQ ID NO:6185
NTLRSPLGDRLNVEVDAAPTVDLNRVLNETRSQYEAL,   SEQ ID NO:6186
NTLRCQLGDRLNVEVDTAPTVDLNRVLNETRSQYEAL,   SEQ ID NO:6187
NTLRSQLGDRLNVEVDTAPTVDLNRVLNETRSQYEAL,   SEQ ID NO:6188
NTLRCPLGDRLNVEVDTAPTVDLNRVLNETRSQYEAL,   SEQ ID NO:6189
NTLRSPLGDRLNVEVDTAPTVDLNRVLNETRSQYEAL,   SEQ ID NO:6190
NTLRCQLGDRLNVEVDAAPTVDLNQVLNETRNQYEAL,   SEQ ID NO:6191
NTLRSQLGDRLNVEVDAAPTVDLNQVLNETRNQYEAL,   SEQ ID NO:6192
NTLRCPLGDRLNVEVDAAPTVDLNQVLNETRNQYEAL,   SEQ ID NO:6193
NTLRSPLGDRLNVEVDAAPTVDLNQVLNETRNQYEAL,   SEQ ID NO:6194
NTLRCQLGDRLNVEVDTAPTVDLNQVLNETRNQYEAL,   SEQ ID NO:6195
NTLRSQLGDRLNVEVDTAPTVDLNQVLNETRNQYEAL,   SEQ ID NO:6196
NTLRCPLGDRLNVEVDTAPTVDLNQVLNETRNQYEAL,   SEQ ID NO:6197
NTLRSPLGDRLNVEVDTAPTVDLNQVLNETRNQYEAL,   SEQ ID NO:6198
NTLRCQLGDRLNVEVDAAPTVDLNRVLNETRNQYEAL,   SEQ ID NO:6199
NTLRSQLGDRLNVEVDAAPTVDLNRVLNETRNQYEAL,   SEQ ID NO:6200
NTLRCPLGDRLNVEVDAAPTVDLNRVLNETRNQYEAL,   SEQ ID NO:6201
NTLRSPLGDRLNVEVDAAPTVDLNRVLNETRNQYEAL,   SEQ ID NO:6202
NTLRCQLGDRLNVEVDTAPTVDLNRVLNETRNQYEAL,   SEQ ID NO:6203
NTLRSQLGDRLNVEVDTAPTVDLNRVLNETRNQYEAL,   SEQ ID NO:6204
NTLRCPLGDRLNVEVDTAPTVDLNRVLNETRNQYEAL,   SEQ ID NO:6205
NTLRSPLGDRLNVEVDTAPTVDLNRVLNETRNQYEAL,   SEQ ID NO:6206
EVNTLRCQLGDRLNVEVDAAPTVDLNQVLNETRSQYEA,  SEQ ID NO:6207
EVNTLRSQLGDRLNVEVDAAPTVDLNQVLNETRSQYEA,  SEQ ID NO:6208
EVNTLRCPLGDRLNVEVDAAPTVDLNQVLNETRSQYEA,  SEQ ID NO:6209
EVNTLRSPLGDRLNVEVDAAPTVDLNQVLNETRSQYEA,  SEQ ID NO:6210
EVNTLRCQLGDRLNVEVDTAPTVDLNQVLNETRSQYEA,  SEQ ID NO:6211
EVNTLRSQLGDRLNVEVDTAPTVDLNQVLNETRSQYEA,  SEQ ID NO:6212
EVNTLRCPLGDRLNVEVDTAPTVDLNQVLNETRSQYEA,  SEQ ID NO:6213
EVNTLRSPLGDRLNVEVDTAPTVDLNQVLNETRSQYEA,  SEQ ID NO:6214
EVNTLRCQLGDRLNVEVDAAPTVDLNRVLNETRSQYEA,  SEQ ID NO:6215
EVNTLRSQLGDRLNVEVDAAPTVDLNRVLNETRSQYEA,  SEQ ID NO:6216
EVNTLRCPLGDRLNVEVDAAPTVDLNRVLNETRSQYEA,  SEQ ID NO:6217
EVNTLRSPLGDRLNVEVDANPTVDLNRVLNETRSQYEA,  SEQ ID NO:6218
EVNTLRCQLGDRLNVEVDTAPTVDLNRVLNETRSQYEA,  SEQ ID NO:6219
EVNTLRSQLGDRLNVEVDTAPTVDLNRVLNETRSQYEA,  SEQ ID NO:6220
EVNTLRCPLGDRLNVEVDTAPTVDLNRVLNETRSQYEA,  SEQ ID NO:6221
EVNTLRSPLGDRLNVEVDTAPTVDLNRVLNETRSQYEA,  SEQ ID NO:6222
EVNTLRCQLGDRLNVEVDAAPTVDLNQVLNETRNQYEA,  SEQ ID NO:6223
EVNTLRSQLGDRLNVEVDAAPTVDLNQVLNETRNQYEA,  SEQ ID NO:6224
EVNTLRCPLGDRLNVEVDAAPTVDLNQVLNETRNQYEA,  SEQ ID NO:6225
EVNTLRSPLGDRLNVEVDAAPTVDLNQVLNETRNQYEA,  SEQ ID NO:6226
EVNTLRCQLGDRLNVEVDTAPTVDLNQVLNETRNQYEA,  SEQ ID NO:6227
EVNTLRSQLGDRLNVEVDTAPTVDLNQVLNETRNQYEA,  SEQ ID NO:6228
EVNTLRCPLGDRLNVEVDTAPTVDLNQVLNETRNQYEA,  SEQ ID NO:6229
EVNTLRSPLGDRLNVEVDTAPTVDLNQVLNETRNQYEA,  SEQ ID NO:6230
```

-continued

```
EVNTLRCQLGDRLNVEVDAAPTVDLNRVLNETRNQYEA, SEQ ID NO:6231
EVNTLRSQLGDRLNVEVDAAPTVDLNRVLNETRNQYEA, SEQ ID NO:6232
EVNTLRCPLGDRLNVEVDAAPTVDLNRVLNETRNQYEA, SEQ ID NO:6233
EVNTLRSPLGDRLNVEVDAAPTVDLNRVLNETRNQYEA, SEQ ID NO:6234
EVNTLRCQLGDRLNVEVDTAPTVDLNRVLNETRNQYEA, SEQ ID NO:6235
EVNTLRSQLGDRLNVEVDTAPTVDLNRVLNETRNQYEA, SEQ ID NO:6236
EVNTLRCPLGDRLNVEVDTAPTVDLNRVLNETRNQYEA, SEQ ID NO:6237
EVNTLRSPLGDRLNVEVDTAPTVDLNRVLNETRNQYEA, SEQ ID NO:6238
VNTLRSPLGDRLNVEVDTAPTVDLNRVLNETRSQYEAL, SEQ ID NO:6254
VNTLRCQLGDRLNVEVDAAPTVDLNQVLNETRNQYEAL, SEQ ID NO:6255
VNTLRSQLGDRLNVEVDAAPTVDLNQVLNETRNQYEAL, SEQ ID NO:6256
VNTLRCPLGDRLNVEVDAAPTVDLNQVLNETRNQYEAL, SEQ ID NO:6257
VNTLRSPLGDRLNVEVDAAPTVDLNQVLNETRNQYEAL, SEQ ID NO:6258
VNTLRCQLGDRLNVEVDTAPTVDLNQVLNETRNQYEAL, SEQ ID NO:6259
VNTLRSQLGDRLNVEVDTAPTVDLNQVLNETRNQYEAL, SEQ ID NO:6260
VNTLRCPLGDRLNVEVDTAPTVDLNQVLNETRNQYEAL, SEQ ID NO:6261
VNTLRSPLGDRLNVEVDTAPTVDLNQVLNETRNQYEAL, SEQ ID NO:6262
VNTLRCQLGDRLNVEVDAAPTVDLNRVLNETRNQYEAL, SEQ ID NO:6263
VNTLRSQLGDRLNVEVDAAPTVDLNRVLNETRNQYEAL, SEQ ID NO:6264
VNTLRCPLGDRLNVEVDAAPTVDLNRVLNETRNQYEAL, SEQ ID NO:6265
VNTLRSPLGDRLNVEVDAAPTVDLNRVLNETRNQYEAL, SEQ ID NO:6266
VNTLRCQLGDRLNVEVDTAPTVDLNRVLNETRNQYEAL, SEQ ID NO:6267
VNTLRSQLGDRLNVEVDTAPTVDLNRVLNETRNQYEAL, SEQ ID NO:6268
VNTLRCQLGDRLNVEVDAAPTVDLNQVLNETRSQYEAL, SEQ ID NO:6239
VNTLRSQLGDRLNVEVDAAPTVDLNQVLNETRSQYEAL, SEQ ID NO:6240
VNTLRCPLGDRLNVEVDAAPTVDLNQVLNETRSQYEAL, SEQ ID NO:6241
VNTLRSPLGDRLNVEVDAAPTVDLNQVLNETRSQYEAL, SEQ ID NO:6242
VNTLRCQLGDRLNVEVDTAPTVDLNQVLNETRSQYEAL, SEQ ID NO:6243
VNTLRSQLGDRLNVEVDTAPTVDLNQVLNETRSQYEAL, SEQ ID NO:6244
VNTLRCPLGDRLNVEVDTAPTVDLNQVLNETRSQYEAL, SEQ ID NO:6245
VNTLRSPLGDRLNVEVDTAPTVDLNQVLNETRSQYEAL, SEQ ID NO:6246
VNTLRCQLGDRLNVEVDAAPTVDLNRVLNETRSQYEAL, SEQ ID NO:6247
VNTLRSQLGDRLNVEVDAAPTVDLNRVLNETRSQYEAL, SEQ ID NO:6248
VNTLRCPLGDRLNVEVDAAPTVDLNRVLNETRSQYEAL, SEQ ID NO:6249
VNTLRSPLGDRLNVEVDAAPTVDLNRVLNETRSQYEAL, SEQ ID NO:6250
VNTLRCQLGDRLNVEVDTAPTVDLNRVLNETRSQYEAL, SEQ ID NO:6251
VNTLRSQLGDRLNVEVDTAPTVDLNRVLNETRSQYEAL, SEQ ID NO:6252
VNTLRCPLGDRLNVEVDTAPTVDLNRVLNETRSQYEAL, SEQ ID NO:6253
VNTLRCPLGDRLNVEVDTAPTVDLNRVLNETRNQYEAL, SEQ ID NO:6269
VNTLRSPLGDRLNVEVDTAPTVDLNRVLNETRNQYEAL, SEQ ID NO:6270
```

As is well known in the art, the use of the designation (C/S) means the amino acid at that position may be either C or S, (Q/P) means the amino acid at that position may be either Q or P, (A/T) means the amino acid at that position may be either A or T, (Q/R) means the amino acid at that position may be either Q or R and (S/N) means the amino acid at that position may be either S or N. It is also understood that the terms C-terminus or carboxy terminus are used interchangeably and are used herein as they are normally used in the art. An amino acid is composed of a carbon atom known as the a-carbon to which is attached a a-carboxylic acid, an a-amine and a side chain. In the peptide bond polymerization, the a-amino group from one amino acid binds to the a-carboxylic acid group of an adjacent amino acid in the peptide polymer. The polymer thus includes a free a-carboxylic acid on one end (the C-terminus) and a free a-amine group on the opposite end (the N-terminus or amino terminus). Any of the peptides disclosed herein may be modified to increase the stability and activity of the compositions as is well known in the art. Such modifications would include, but is not limited to bonding of acetyl or amide groups to the appropriate ends of the peptides.

It is also understood that one of skill in the art would understand that the peptides are disclosed using the one letter amino acid abbreviations as follows:

A=Ala=alanine
R=Arg=arginine
N=Asp=asparagine
D=Asp=aspartic acid
C=Cys=cysteine
E=Glu=glutamic acid
Q=Gln=glutamine
G=Gly=glycine
H=His=histidine
I=Ile=isoleucine
L=Leu=leucine
K=Lys=lysine
M=Met=methionine
F=Phe=phenylalanine
P=Pro=proline
S=Ser=serine
T=Thr=threonine
W=Trp=tryptophan
Y=Tyr=tyrosine
V=Val=valine The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the spirit and scope of the invention.

EXAMPLE 1

Selected peptides derived from the keratin consensus sequence were chemically synthesized and used to demonstrate the bioactivity of the peptides. Normal human adult dermal fibroblasts were cultured in fibroblast growth medium (Clonetics™/BioWhittaker, San Diego, Calif., USA). Passage 5 cells were seeded into wells of 96 well plates at 5×10³ cells/well. Test peptide solutions were prepared at approximately 1.5 mg/ml in sterile water. Small volumes of 0.1N NH4OH were added dropwise to peptide the peptide solutions to completely solubilize the peptides as recommended by the manufacturer (New England Peptide, Inc., Fitchburg, Miss., USA). The volume of NH4OH added to the solution was recorded and used to adjust beginning concentration. Solutions were serially diluted in fibroblast culture medium from 100-0.001 μg/ml, then added to the cells and cultured for 5 days. At day 3, test and control media were removed from each well by vacuum and replaced with fresh test or control solutions. Samples were evaluated in 4 replicate wells. Note in each plate, wells were selected at random to be used as baseline controls to account for any variation in cell seeding between plates. After 5 days, cell proliferation was assessed spectrophotometrically using the Cell Titer96® Cell Proliferation Assay (Promega Corp., Madison, Wis., USA). Absorbance values were normalized to baseline controls and expressed as percent increased (positive values) or decreased (negative values) proliferation.

| Mitogenic Effects of 19 Peptides on Human Fibroblasts in Culture for 5 Days | | | | | | | | |
|---|---|---|---|---|---|---|---|---|
| Peptides for Cell Culture Studies | | | concentration (ug/mL) | | | | | |
| Peptide | Acidity | MW | 100 | 10 | 1 | 0.1 | 0.01 | 0.001 |
| H2N-VEVDAA-OH | acidic 2× | 602 | −9.5% | −1.3% | −4.7% | −9.0% | 2.3% | 11.0% |
| H2N-SPLGD-OH | acidic 1× | 487 | −4.3% | −1.2% | 1.5% | −4.2% | 1.7% | 11.8% |
| H2N-LGDRL-OH | acid/base | 572 | −3.8% | −3.1% | −4.8% | 0.6% | 0.0% | 10.3% |
| H2N-DLNRVL-OH | acid/base | 728 | −1.2% | −3.5% | −2.8% | −0.4% | 11.5% | 14.4% |
| H2N-DLNQ-OH | acidic 1× | 488 | −3.6% | −0.7% | −0.8% | 2.6% | 8.9% | 15.9% |
| H2N-VDTAPTV-OH | acidic 1× | 701 | −5.5% | 5.5% | 0.7% | 1.2% | 7.9% | 10.4% |
| H2N-AAPTV-OH | neutral | 457 | −5.9% | −5.9% | 2.8% | 0.3% | −0.2% | 11.0% |
| H2N-AAPTVD-OH | acidic 1× | 572 | 1.6% | −2.0% | 1.7% | −1.1% | 7.9% | 11.6% |
| H2N-DAAPTV-OH | acidic 1× | 572 | −2.7% | −6.1% | 3.5% | 7.5% | 9.5% | −3.0% |
| H2N-TAPTV-OH | neutral | 487 | 0.7% | −2.7% | 8.2% | 9.4% | −1.2% | 5.2% |
| H2N-DTAPTV-OH | acidic 1× | 602 | 7.6% | 2.2% | 2.9% | 6.7% | 2.5% | 3.2% |
| H2N-TAPTVD-OH | acidic 1× | 602 | 6.9% | 4.0% | 2.1% | −0.5% | −0.9% | 0.3% |
| H2N-APTVDLN-OH | acidic 1× | 728 | 6.7% | 8.1% | −6.0% | 2.8% | 3.9% | 1.2% |
| H2N-VDTAPT-OH | acidic 1× | 602 | 4.4% | −0.1% | 2.5% | 6.8% | 4.2% | 9.0% |
| H2N-EVDAAPT-OH | acidic 2× | 701 | 4.1% | 16.5% | 7.1% | 5.4% | 8.9% | 6.5% |
| H2N-VDAAPT-OH | acidic 1× | 572 | 13.3% | 6.2% | 4.5% | −3.6% | 2.9% | 1.6% |
| H2N-RLNVEV-OH | acid/base | 728 | 10.6% | 6.4% | 1.9% | −4.3% | −6.0% | −2.6% |
| H2N-LNVEV-OH | acidic 1× | 572 | 13.9% | 15.9% | −11.4% | −10.8% | 0.9% | −1.0% |
| H2N-TLRSP-OH | basic 1× | 572 | 18.8% | 14.7% | 6.6% | 7.7% | 1.9% | 4.7% |
| Fibroblast GF | | | | | | | | 70.3% |

It is understood that the test concentrations may be further optimized to determine the optimal concentration of each peptide formulation for either activation or inhibition of cell proliferation. However, the data contained in this example demonstrate the activity of the peptide compositions in the fibroblast assay. The test data further demonstrates like activity for peptides that contain thematic amino acid sequences LGD, DLN, APTV, SEQ ID NO:67, or LNVEV, SEQ ID NO:117.

Numerous advantages of the invention covered by this document have been set forth in the foregoing description. It will be understood, however, that this disclosure is, in many respects, only illustrative. Changes may be made in details, particularly in matters of reagents, concentrations, and step order, and still fall within the spirit and scope of the invention.

SEQUENCE LISTING (4469 sequences)

SEQ ID NO: 1 - protein, 39 aa, Artificial
  Consensus peptide
EVNTLRCQLGDRLNVEVDAAPTVDLNQVLNETRSQYEAL

SEQ ID NO: 2 - protein, 39 aa, Artificial
  Consensus peptide
EVNTLRSQLGDRLNVEVDAAPTVDLNQVLNETRSQYEAL

SEQ ID NO: 3 - protein, 39 aa, Artificial
  Consensus peptide
EVNTLRCPLGDRLNVEVDAAPTVDLNQVLNETRSQYEAL

SEQ ID NO: 4 - protein, 39 aa, Artificial
  Consensus peptide
EVNTLRSPLGDRLNVEVDAAPTVDLNQVLNETRSQYEAL

SEQ ID NO: 5 - protein, 39 aa, Artificial
  Consensus peptide
EVNTLRCQLGDRLNVEVDTAPTVDLNQVLNETRSQYEAL

SEQ ID NO: 6 - protein, 39 aa, Artificial
  Consensus peptide
EVNTLRSQLGDRLNVEVDTAPTVDLNQVLNETRSQYEAL

SEQ ID NO: 7 - protein, 39 aa, Artificial
  Consensus peptide
EVNTLRCPLGDRLNVEVDTAPTVDLNQVLNETRSQYEAL

SEQ ID NO: 8 - protein, 39 aa, Artificial
  Consensus peptide
EVNTLRSPLGDRLNVEVDTAPTVDLNQVLNETRSQYEAL

SEQ ID NO: 9 - protein, 39 aa, Artificial
  Consensus peptide
EVNTLRCQLGDRLNVEVDAAPTVDLNRVLNETRSQYEAL

SEQ ID NO: 10 - protein, 39 aa, Artificial
  Consensus peptide
EVNTLRSQLGDRLNVEVDAAPTVDLNRVLNETRSQYEAL

SEQ ID NO: 11 - protein, 38 aa, Artificial
  Consensus peptide
VNTLRCPLGDRLNVEVDAAPTVDLNRVLNETRSQYEAL

SEQ ID NO: 12 - protein, 39 aa, Artificial
  Consensus peptide
EVNTLRSPLGDRLNVEVDAAPTVDLNRVLNETRSQYEAL

SEQ ID NO: 13 - protein, 39 aa, Artificial
  Consensus peptide
EVNTLRCQLGDRLNVEVDTAPTVDLNRVLNETRSQYEAL

SEQ ID NO: 14 - protein, 39 aa, Artificial
  Consensus peptide
EVNTLRSQLGDRLNVEVDTAPTVDLNRVLNETRSQYEAL

SEQ ID NO: 15 - protein, 39 aa, Artificial
  Consensus peptide
EVNTLRCPLGDRLNVEVDTAPTVDLNRVLNETRSQYEAL

SEQ ID NO: 16 - protein, 39 aa, Artificial
  Consensus peptide
EVNTLRSPLGDRLNVEVDTAPTVDLNRVLNETRSQYEAL

SEQ ID NO: 17 - protein, 39 aa, Artificial
  Consensus peptide
EVNTLRCQLGDRLNVEVDAAPTVDLNQVLNETRNQYEAL

SEQ ID NO: 18 - protein, 39 aa, Artificial
  Consensus peptide
EVNTLRSQLGDRLNVEVDAAPTVDLNQVLNETRNQYEAL

SEQ ID NO: 19 - protein, 39 aa, Artificial
  Consensus peptide
EVNTLRCPLGDRLNVEVDAAPTVDLNQVLNETRNQYEAL

SEQ ID NO: 20 - protein, 39 aa, Artificial
  Consensus peptide
EVNTLRSPLGDRLNVEVDAAPTVDLNQVLNETRNQYEAL

SEQ ID NO: 21 - protein, 39 aa, Artificial
  Consensus peptide
EVNTLRCQLGDRLNVEVDTAPTVDLNQVLNETRNQYEAL

SEQ ID NO: 22 - protein, 39 aa, Artificial
  Consensus peptide
EVNTLRSQLGDRLNVEVDTAPTVDLNQVLNETRNQYEAL

SEQ ID NO: 23 - protein, 39 aa, Artificial
  Consensus peptide
EVNTLRCPLGDRLNVEVDTAPTVDLNQVLNETRNQYEAL

SEQ ID NO: 24 - protein, 39 aa, Artificial
  Consensus peptide
EVNTLRSPLGDRLNVEVDTAPTVDLNQVLNETRNQYEAL

SEQ ID NO: 25 - protein, 39 aa, Artificial
  Consensus peptide
EVNTLRCQLGDRLNVEVDAAPTVDLNRVLNETRNQYEAL

SEQ ID NO: 26 - protein, 39 aa, Artificial
  Consensus peptide
EVNTLRSQLGDRLNVEVDAAPTVDLNRVLNETRNQYEAL

SEQ ID NO: 27 - protein, 39 aa, Artificial
  Consensus peptide
EVNTLRCPLGDRLNVEVDAAPTVDLNRVLNETRNQYEAL

SEQ ID NO: 28 - protein, 39 aa, Artificial
  Consensus peptide
EVNTLRSPLGDRLNVEVDAAPTVDLNRVLNETRNQYEAL

SEQ ID NO: 29 - protein, 39 aa, Artificial
  Consensus peptide
EVNTLRCQLGDRLNVEVDTAPTVDLNRVLNETRNQYEAL

SEQ ID NO: 30 - protein, 39 aa, Artificial
  Consensus peptide
EVNTLRSQLGDRLNVEVDTAPTVDLNRVLNETRNQYEAL

SEQ ID NO: 31 - protein, 39 aa, Artificial
  Consensus peptide
EVNTLRCPLGDRLNVEVDTAPTVDLNRVLNETRNQYEAL

SEQ ID NO: 32 - protein, 39 aa, Artificial
  Consensus peptide
EVNTLRSPLGDRLNVEVDTAPTVDLNRVLNETRNQYEAL

SEQ ID NO: 33 - protein, 4 aa, Artificial
  Consensus peptide
EVNT

SEQ ID NO: 34 - protein, 4 aa, Artificial
  Consensus peptide
VNTL

SEQ ID NO: 35 - protein, 4 aa, Artificial
  Consensus peptide
NTLR

SEQ ID NO: 36 - protein, 4 aa, Artificial
  Consensus peptide
TLRC

SEQ ID NO: 37 - protein, 4 aa, Artificial
  Consensus peptide
TLRS

SEQ ID NO: 38 - protein, 4 aa, Artificial
  Consensus peptide
LRCQ

SEQ ID NO: 39 - protein, 4 aa, Artificial
  Consensus peptide
LRCP

SEQ ID NO: 40 - protein, 4 aa, Artificial
  Consensus peptide
LRSQ

SEQ ID NO: 41 - protein, 4 aa, Artificial
  Consensus peptide
LRSP

SEQ ID NO: 42 - protein, 4 aa, Artificial
  Consensus peptide
RCQL

SEQ ID NO: 43 - protein, 4 aa, Artificial
  Consensus peptide
RSQL

SEQ ID NO: 44 - protein, 4 aa, Artificial
  Consensus peptide
RCPL

SEQ ID NO: 45 - protein, 4 aa, Artificial
  Consensus peptide
RSPL

SEQ ID NO: 46 - protein, 4 aa, Artificial
  Consensus peptide
CQLG

SEQ ID NO: 47 - protein, 4 aa, Artificial
  Consensus peptide
CPLG

SEQ ID NO: 48 - protein, 4 aa, Artificial
  Consensus peptide
SQLG

SEQ ID NO: 49 - protein, 4 aa, Artificial
  Consensus peptide
SPLG

SEQ ID NO: 50 - protein, 4 aa, Artificial
  Consensus peptide
QLGD

SEQ ID NO: 51 - protein, 4 aa, Artificial
  Consensus peptide
PLGD

SEQ ID NO: 52 - protein, 4 aa, Artificial
  Consensus peptide
LGDR

SEQ ID NO: 53 - protein, 4 aa, Artificial
  Consensus peptide
GDRL

SEQ ID NO: 54 - protein, 4 aa, Artificial
  Consensus peptide
DRLN

SEQ ID NO: 55 - protein, 4 aa, Artificial
  Consensus peptide
RLNV

SEQ ID NO: 56 - protein, 4 aa, Artificial
  Consensus peptide
LNVE

SEQ ID NO: 57 - protein, 4 aa, Artificial
  Consensus peptide
NVEV

SEQ ID NO: 58 - protein, 4 aa, Artificial
  Consensus peptide
VEVD

SEQ ID NO: 59 - protein, 4 aa, Artificial
  Consensus peptide
EVDA

SEQ ID NO: 60 - protein, 4 aa, Artificial
  Consensus peptide
EVDT

SEQ ID NO: 61 - protein, 4 aa, Artificial
  Consensus peptide
VDAA

SEQ ID NO: 62 - protein, 4 aa, Artificial
  Consensus peptide
VDTA

SEQ ID NO: 63 - protein, 4 aa, Artificial
  Consensus peptide
DAAP

SEQ ID NO: 64 - protein, 4 aa, Artificial
  Consensus peptide
DTAP

SEQ ID NO: 65 - protein, 4 aa, Artificial
  Consensus peptide
AAPT

SEQ ID NO: 66 - protein, 4 aa, Artificial
  Consensus peptide
TATP

SEQ ID NO: 67 - protein, 4 aa, Artificial
  Consensus peptide
APTV

SEQ ID NO: 68 - protein, 4 aa, Artificial
  Consensus peptide
PTVD

SEQ ID NO: 69 - protein, 4 aa, Artificial
  Consensus peptide
TVDL

SEQ ID NO: 70 - protein, 4 aa, Artificial
  Consensus peptide
VDLN

SEQ ID NO: 71 - protein, 4 aa, Artificial
  Consensus peptide
DLNQ

SEQ ID NO: 72 - protein, 4 aa, Artificial
  Consensus peptide
DLNR

SEQ ID NO: 73 - protein, 4 aa, Artificial
  Consensus peptide
LNQV

SEQ ID NO: 74 - protein, 4 aa, Artificial
  Consensus peptide
LNRV

SEQ ID NO: 75 - protein, 4 aa, Artificial
  Consensus peptide
NQVL

SEQ ID NO: 76 - protein, 4 aa, Artificial
  Consensus peptide
NRVL

SEQ ID NO: 77 - protein, 4 aa, Artificial
  Consensus peptide
QVLN

SEQ ID NO: 78 - protein, 4 aa, Artificial
  Consensus peptide
RVLN

SEQ ID NO: 79 - protein, 4 aa, Artificial
  Consensus peptide
VLNE

SEQ ID NO: 80 - protein, 4 aa, Artificial
  Consensus peptide
LNET

SEQ ID NO: 81 - protein, 4 aa, Artificial
  Consensus peptide
NETR

SEQ ID NO: 82 - protein, 4 aa, Artificial
  Consensus peptide
ETRS

SEQ ID NO: 83 - protein, 4 aa, Artificial
  Consensus peptide
ETRN

SEQ ID NO: 84 - protein, 4 aa, Artificial
  Consensus peptide
TRSQ

SEQ ID NO: 85 - protein, 4 aa, Artificial
  Consensus peptide
TRNQ

SEQ ID NO: 86 - protein, 4 aa, Artificial
  Consensus peptide
RSQY

SEQ ID NO: 87 - protein, 4 aa, Artificial
  Consensus peptide
RNQY

SEQ ID NO: 88 - protein, 4 aa, Artificial
  Consensus peptide
SQYE

SEQ ID NO: 89 - protein, 4 aa, Artificial
  Consensus peptide
NQYE

SEQ ID NO: 90 - protein, 4 aa, Artificial
  Consensus peptide
QYEA

SEQ ID NO: 91 - protein, 4 aa, Artificial
  Consensus peptide
YEAL

SEQ ID NO: 92 - protein, 5 aa, Artificial
  Consensus peptide
EVNTL

SEQ ID NO: 93 - protein, 5 aa, Artificial
  Consensus peptide
VNTLR

SEQ ID NO: 94 - protein, 5 aa, Artificial
  Consensus peptide
NTLRC

SEQ ID NO: 95 - protein, 5 aa, Artificial
  Consensus peptide
NTLRS

SEQ ID NO: 96 - protein, 5 aa, Artificial
  Consensus peptide
TLRCQ

SEQ ID NO: 97 - protein, 5 aa, Artificial
  Consensus peptide
TLRSQ

SEQ ID NO: 98 - protein, 5 aa, Artificial
  Consensus peptide
TLRCP

SEQ ID NO: 99 - protein, 5 aa, Artificial
  Consensus peptide
TLRSP

SEQ ID NO: 100 - protein, 5 aa, Artificial
  Consensus peptide
LRCPL

SEQ ID NO: 101 - protein, 5 aa, Artificial
  Consensus peptide
LRCPL

SEQ ID NO: 102 - protein, 5 aa, Artificial
  Consensus peptide
LRSQL

SEQ ID NO: 103 - protein, 5 aa, Artificial
  Consensus peptide
LRSPL

SEQ ID NO: 104 - protein, 5 aa, Artificial
  Consensus peptide
RCQLG

SEQ ID NO: 105 - protein, 5 aa, Artificial
  Consensus peptide
RCPLG

SEQ ID NO: 106 - protein, 5 aa, Artificial
  Consensus peptide
RSQLG

SEQ ID NO: 107 - protein, 5 aa, Artificial
  Consensus peptide
RSPLG

SEQ ID NO: 108 - protein, 5 aa, Artificial
  Consensus peptide
CQLGD

SEQ ID NO: 109 - protein, 5 aa, Artificial
  Consensus peptide
CPLGD

SEQ ID NO: 110 - protein, 5 aa, Artificial
  Consensus peptide
SQLGD

SEQ ID NO: 111 - protein, 5 aa, Artificial
  Consensus peptide
SPLGD

SEQ ID NO: 112 - protein, 5 aa, Artificial
  Consensus peptide
QLGDR

SEQ ID NO: 113 - protein, 5 aa, Artificial
  Consensus peptide
PLGDR

SEQ ID NO: 114 - protein, 5 aa, Artificial
  Consensus peptide
LGDRL

SEQ ID NO: 115 - protein, 5 aa, Artificial
  Consensus peptide
GDRLN

SEQ ID NO: 116 - protein, 5 aa, Artificial
  Consensus peptide
DRLNV

SEQ ID NO: 117 - protein, 5 aa, Artificial
  Consensus peptide
RLNVE

SEQ ID NO: 118 - protein, 5 aa, Artificial
  Consensus peptide
LNVEV

SEQ ID NO: 119 - protein, 5 aa, Artificial
  Consensus peptide
NVEVD

SEQ ID NO: 120 - protein, 5 aa, Artificial
  Consensus peptide
VEVDA

SEQ ID NO: 121 - protein, 5 aa, Artificial
  Consensus peptide
VEVDT

SEQ ID NO: 122 - protein, 5 aa, Artificial
  Consensus peptide
EVDAA

SEQ ID NO: 123 - protein, 5 aa, Artificial
  Consensus peptide
EVDTA

SEQ ID NO: 124 - protein, 5 aa, Artificial
  Consensus peptide
VDAAP

SEQ ID NO: 125 - protein, 5 aa, Artificial
  Consensus peptide
VDTAP

SEQ ID NO: 126 - protein, 5 aa, Artificial
  Consensus peptide
DAAPT

SEQ ID NO: 127 - protein, 5 aa, Artificial
  Consensus peptide
DTAPT

SEQ ID NO: 128 - protein, 5 aa, Artificial
  Consensus peptide
AAPTV

SEQ ID NO: 129 - protein, 5 aa, Artificial
  Consensus peptide
TAPTV

SEQ ID NO: 130 - protein, 5 aa, Artificial
  Consensus peptide
APTVD

SEQ ID NO: 131 - protein, 5 aa, Artificial
  Consensus peptide
PTVDL

SEQ ID NO: 132 - protein, 5 aa, Artificial
  Consensus peptide
TVDLN

SEQ ID NO: 133 - protein, 5 aa, Artificial
  Consensus peptide
VDLNQ

SEQ ID NO: 134 - protein, 5 aa, Artificial
  Consensus peptide
VDLNR

SEQ ID NO: 135 - protein, 5 aa, Artificial
  Consensus peptide
DLNQV

SEQ ID NO: 136 - protein, 5 aa, Artificial
  Consensus peptide
DLNRV

SEQ ID NO: 137 - protein, 5 aa, Artificial
  Consensus peptide
LNQVL

SEQ ID NO: 138 - protein, 5 aa, Artificial
  Consensus peptide
LNRVL

SEQ ID NO: 139 - protein, 5 aa, Artificial
  Consensus peptide
NQVLN

SEQ ID NO: 140 - protein, 5 aa, Artificial
  Consensus peptide
NRVLN

SEQ ID NO: 141 - protein, 5 aa, Artificial
  Consensus peptide
QVLNE

SEQ ID NO: 142 - protein, 5 aa, Artificial
  Consensus peptide
RVLNE

SEQ ID NO: 143 - protein, 5 aa, Artificial
  Consensus peptide
VLNET

SEQ ID NO: 144 - protein, 5 aa, Artificial
  Consensus peptide
LNETR

SEQ ID NO: 145 - protein, 5 aa, Artificial
  Consensus peptide
NETRS

SEQ ID NO: 146 - protein, 5 aa, Artificial
  Consensus peptide
NETRN

SEQ ID NO: 147 - protein, 5 aa, Artificial
  Consensus peptide
ETRSQ

SEQ ID NO: 148 - protein, 5 aa, Artificial
  Consensus peptide
ETRNQ

SEQ ID NO: 149 - protein, 5 aa, Artificial
  Consensus peptide
TRSQY

SEQ ID NO: 150 - protein, 5 aa, Artificial
  Consensus peptide
TRNQY

SEQ ID NO: 151 - protein, 5 aa, Artificial
  Consensus peptide
RSQYE

SEQ ID NO: 152 - protein, 5 aa, Artificial
  Consensus peptide
RNQYE

SEQ ID NO: 153 - protein, 5 aa, Artificial
  Consensus peptide
SQYEA

SEQ ID NO: 154 - protein, 5 aa, Artificial
  Consensus peptide
NQYEA

SEQ ID NO: 155 - protein, 5 aa, Artificial
  Consensus peptide
QYEAL

SEQ ID NO: 156 - protein, 6 aa, Artificial
  Consensus peptide
EVNTLR

SEQ ID NO: 157 - protein, 6 aa, Artificial
  Consensus peptide
VNTLRC

SEQ ID NO: 158 - protein, 6 aa, Artificial
  Consensus peptide
VNTLRS

SEQ ID NO: 159 - protein, 6 aa, Artificial
  Consensus peptide
NTLRCQ

SEQ ID NO: 160 - protein, 6 aa, Artificial
  Consensus peptide
NTLRCP

SEQ ID NO: 161 - protein, 6 aa, Artificial
  Consensus peptide
NTLRSQ

SEQ ID NO: 162 - protein, 5 aa, Artificial
  Consensus peptide
NLRSP

SEQ ID NO: 163 - protein, 6 aa, Artificial
  Consensus peptide
TLRCQL

SEQ ID NO: 164 - protein, 6 aa, Artificial
  Consensus peptide
TLRCPL

SEQ ID NO: 165 - protein, 6 aa, Artificial
  Consensus peptide
TLRSQL

SEQ ID NO: 166 - protein, 6 aa, Artificial
  Consensus peptide
TLRSPL

SEQ ID NO: 167 - protein, 6 aa, Artificial
  Consensus peptide
LRCQLG

SEQ ID NO: 168 - protein, 6 aa, Artificial
  Consensus peptide
LRCPLG

SEQ ID NO: 169 - protein, 6 aa, Artificial
  Consensus peptide
LRSQLG

SEQ ID NO: 170 - protein, 6 aa, Artificial
  Consensus peptide
LRSPLG

SEQ ID NO: 171 - protein, 6 aa, Artificial
  Consensus peptide
RCQLGD

SEQ ID NO: 172 - protein, 6 aa, Artificial
  Consensus peptide
RCPLGD

SEQ ID NO: 173 - protein, 6 aa, Artificial
  Consensus peptide
RSQLGD

SEQ ID NO: 174 - protein, 6 aa, Artificial
  Consensus peptide
RSPLGD

SEQ ID NO: 175 - protein, 6 aa, Artificial
  Consensus peptide
CQLGDR

SEQ ID NO: 176 - protein, 6 aa, Artificial
  Consensus peptide
CPLGDR

SEQ ID NO: 177 - protein, 6 aa, Artificial
  Consensus peptide
SQLGDR

SEQ ID NO: 178 - protein, 6 aa, Artificial
  Consensus peptide
SPLGDR

SEQ ID NO: 179 - protein, 6 aa, Artificial
  Consensus peptide
QLGDRL

SEQ ID NO: 180 - protein, 6 aa, Artificial
  Consensus peptide
PLGDRL

SEQ ID NO: 181 - protein, 6 aa, Artificial
  Consensus peptide
LGDRLN

SEQ ID NO: 182 - protein, 6 aa, Artificial
  Consensus peptide
GDRLNV

SEQ ID NO: 183 - protein, 6 aa, Artificial
  Consensus peptide
DRLNVE

SEQ ID NO: 184 - protein, 6 aa, Artificial
  Consensus peptide
RLNVEV

SEQ ID NO: 185 - protein, 6 aa, Artificial
  Consensus peptide
LNVEVD

SEQ ID NO: 186 - protein, 6 aa, Artificial
  Consensus peptide
NVEVDA

SEQ ID NO: 187 - protein, 6 aa, Artificial
  Consensus peptide
NVEVDT

SEQ ID NO: 188 - protein, 6 aa, Artificial
  Consensus peptide
VEVDAA

SEQ ID NO: 189 - protein, 6 aa, Artificial
  Consensus peptide
VEVDTA

SEQ ID NO: 190 - protein, 6 aa, Artificial
  Consensus peptide
EVDAAP

SEQ ID NO: 191 - protein, 6 aa, Artificial
  Consensus peptide
EVDTAP

SEQ ID NO: 192 - protein, 6 aa, Artificial
  Consensus peptide
VDAAPT

SEQ ID NO: 193 - protein, 6 aa, Artificial
  Consensus peptide
VDTAPT

SEQ ID NO: 194 - protein, 6 aa, Artificial
  Consensus peptide
DAAPTV

SEQ ID NO: 195 - protein, 6 aa, Artificial
  Consensus peptide
DTAPTV

SEQ ID NO: 196 - protein, 6 aa, Artificial
  Consensus peptide
AAPTVD

SEQ ID NO: 197 - protein, 6 aa, Artificial
  Consensus peptide
TAPTVD

SEQ ID NO: 198 - protein, 6 aa, Artificial
  Consensus peptide
APTVDL

SEQ ID NO: 199 - protein, 6 aa, Artificial
  Consensus peptide
PTVDLN

SEQ ID NO: 200 - protein, 6 aa, Artificial
  Consensus peptide
TVDLNQ

SEQ ID NO: 201 - protein, 6 aa, Artificial
  Consensus peptide
TVDLNR

SEQ ID NO: 202 - protein, 6 aa, Artificial
  Consensus peptide
VDLNQV

SEQ ID NO: 203 - protein, 6 aa, Artificial
  Consensus peptide
VDLNRV

SEQ ID NO: 204 - protein, 6 aa, Artificial
  Consensus peptide
DLNQVL

SEQ ID NO: 205 - protein, 6 aa, Artificial
  Consensus peptide
DLNRVL

SEQ ID NO: 206 - protein, 6 aa, Artificial
  Consensus peptide
LNQVLN

SEQ ID NO: 207 - protein, 6 aa, Artificial
  Consensus peptide
LNRVLN

SEQ ID NO: 208 - protein, 6 aa, Artificial
  Consensus peptide
NQVLNE

SEQ ID NO: 209 - protein, 6 aa, Artificial
  Consensus peptide
NRVLNE

SEQ ID NO: 210 - protein, 6 aa, Artificial
  Consensus peptide
QVLNET

SEQ ID NO: 211 - protein, 6 aa, Artificial
  Consensus peptide
RVLNET

SEQ ID NO: 212 - protein, 6 aa, Artificial
  Consensus peptide
VLNETR

SEQ ID NO: 213 - protein, 6 aa, Artificial
  Consensus peptide
LNETRS

SEQ ID NO: 214 - protein, 6 aa, Artificial
  Consensus peptide
LNETRN

SEQ ID NO: 215 - protein, 6 aa, Artificial
  Consensus peptide
NETRSQ

SEQ ID NO: 216 - protein, 6 aa, Artificial
  Consensus peptide
NETRNQ

SEQ ID NO: 217 - protein, 6 aa, Artificial
  Consensus peptide
ETRSQY

SEQ ID NO: 218 - protein, 6 aa, Artificial
  Consensus peptide
ETRNQY

SEQ ID NO: 219 - protein, 6 aa, Artificial
  Consensus peptide
TRSQYE

SEQ ID NO: 220 - protein, 6 aa, Artificial
  Consensus peptide
TRNQYE

SEQ ID NO: 221 - protein, 6 aa, Artificial
  Consensus peptide
RSQYEA

SEQ ID NO: 222 - protein, 6 aa, Artificial
  Consensus peptide
RNQYEA

SEQ ID NO: 223 - protein, 6 aa, Artificial
  Consensus peptide
SQYEAL

SEQ ID NO: 224 - protein, 6 aa, Artificial
  Consensus peptide
NQYEAL

SEQ ID NO: 225 - protein, 7 aa, Artificial
  Consensus peptide
EVNTLRC

SEQ ID NO: 226 - protein, 7 aa, Artificial
  Consensus peptide
EVNTLRS

SEQ ID NO: 227 - protein, 7 aa, Artificial
  Consensus peptide
VNTLRCQ

SEQ ID NO: 228 - protein, 7 aa, Artificial
  Consensus peptide
VNTLRCP

SEQ ID NO: 229 - protein, 7 aa, Artificial
  Consensus peptide
VNTLRSQ

SEQ ID NO: 230 - protein, 7 aa, Artificial
  Consensus peptide
VNTLRSP

SEQ ID NO: 231 - protein, 7 aa, Artificial
  Consensus peptide
NTLRCQL

SEQ ID NO: 232 - protein, 7 aa, Artificial
  Consensus peptide
NTLRCPL

SEQ ID NO: 233 - protein, 7 aa, Artificial
  Consensus peptide
NTLRSQL

SEQ ID NO: 234 - protein, 7 aa, Artificial
  Consensus peptide
NTLRSPL

SEQ ID NO: 235 - protein, 7 aa, Artificial
  Consensus peptide
TLRCQLG

SEQ ID NO: 236 - protein, 7 aa, Artificial
  Consensus peptide
TLRCPLG

SEQ ID NO: 237 - protein, 7 aa, Artificial
  Consensus peptide
TLRSQLG

SEQ ID NO: 238 - protein, 7 aa, Artificial
  Consensus peptide
TLRSPLG

SEQ ID NO: 239 - protein, 7 aa, Artificial
  Consensus peptide
LRCQLGD

SEQ ID NO: 240 - protein, 7 aa, Artificial
  Consensus peptide
LRCPLGD

SEQ ID NO: 241 - protein, 7 aa, Artificial
  Consensus peptide
LRSQLGD

SEQ ID NO: 242 - protein, 7 aa, Artificial
  Consensus peptide
LRSPLGD

SEQ ID NO: 243 - protein, 7 aa, Artificial
  Consensus peptide
RCQLGDR

SEQ ID NO: 244 - protein, 7 aa, Artificial
  Consensus peptide
RCPLGDR

SEQ ID NO: 245 - protein, 7 aa, Artificial
  Consensus peptide
RSQLGDR

SEQ ID NO: 246 - protein, 7 aa, Artificial
  Consensus peptide
RSPLGDR

SEQ ID NO: 247 - protein, 7 aa, Artificial
  Consensus peptide
CQLGDRL

SEQ ID NO: 248 - protein, 7 aa, Artificial
  Consensus peptide
CPLGDRL

SEQ ID NO: 249 - protein, 7 aa, Artificial
  Consensus peptide
SQLGDRL

SEQ ID NO: 250 - protein, 7 aa, Artificial
  Consensus peptide
SPLGDRL

SEQ ID NO: 251 - protein, 7 aa, Artificial
  Consensus peptide
QLGDRLN

SEQ ID NO: 252 - protein, 7 aa, Artificial
  Consensus peptide
PLGDRLN

SEQ ID NO: 253 - protein, 7 aa, Artificial
  Consensus peptide
LGDRLNV

SEQ ID NO: 254 - protein, 7 aa, Artificial
  Consensus peptide
GDRLNVE

SEQ ID NO: 255 - protein, 7 aa, Artificial
  Consensus peptide
DRLNVEV

SEQ ID NO: 256 - protein, 7 aa, Artificial
  Consensus peptide
RLNVEVD

SEQ ID NO: 257 - protein, 7 aa, Artificial
  Consensus peptide
LNVEVDA

SEQ ID NO: 258 - protein, 7 aa, Artificial
  Consensus peptide
LNVEVDT

SEQ ID NO: 259 - protein, 7 aa, Artificial
  Consensus peptide
NVEVDAA

SEQ ID NO: 260 - protein, 7 aa, Artificial
  Consensus peptide
NVEVDTA

SEQ ID NO: 261 - protein, 7 aa, Artificial
  Consensus peptide
VEVDAAP

SEQ ID NO: 262 - protein, 7 aa, Artificial
  Consensus peptide
VEVDTAP

SEQ ID NO: 263 - protein, 7 aa, Artificial
  Consensus peptide
EVDAAPT

SEQ ID NO: 264 - protein, 7 aa, Artificial
  Consensus peptide
EVDTAPT

SEQ ID NO: 265 - protein, 7 aa, Artificial
  Consensus peptide
VDAAPTV

SEQ ID NO: 266 - protein, 7 aa, Artificial
  Consensus peptide
VDTAPTV

SEQ ID NO: 267 - protein, 7 aa, Artificial
  Consensus peptide
DAAPTVD

SEQ ID NO: 268 - protein, 7 aa, Artificial
  Consensus peptide
DTAPTVD

SEQ ID NO: 269 - protein, 7 aa, Artificial
  Consensus peptide
AAPTVDL

SEQ ID NO: 270 - protein, 7 aa, Artificial
  Consensus peptide
TAPTVDL

SEQ ID NO: 271 - protein, 7 aa, Artificial
  Consensus peptide
APTVDLN

SEQ ID NO: 272 - protein, 7 aa, Artificial
  Consensus peptide
PTVDLNQ

SEQ ID NO: 273 - protein, 7 aa, Artificial
  Consensus peptide
PTVDLNR

SEQ ID NO: 274 - protein, 7 aa, Artificial
  Consensus peptide
TVDLNQV

SEQ ID NO: 275 - protein, 7 aa, Artificial
  Consensus peptide
TVDLNRV

SEQ ID NO: 276 - protein, 7 aa, Artificial
  Consensus peptide
VDLNQVL

SEQ ID NO: 277 - protein, 7 aa, Artificial
  Consensus peptide
VDLNRVL

SEQ ID NO: 278 - protein, 7 aa, Artificial
  Consensus peptide
DLNQVLN

SEQ ID NO: 279 - protein, 7 aa, Artificial
  Consensus peptide
DLNRVLN

SEQ ID NO: 280 - protein, 7 aa, Artificial
  Consensus peptide
LNQVLNE

SEQ ID NO: 281 - protein, 7 aa, Artificial
  Consensus peptide
LNRVLNE

SEQ ID NO: 282 - protein, 7 aa, Artificial
  Consensus peptide
NQVLNET

SEQ ID NO: 283 - protein, 7 aa, Artificial
  Consensus peptide
NRVLNET

SEQ ID NO: 284 - protein, 7 aa, Artificial
  Consensus peptide
QVLNETR

SEQ ID NO: 285 - protein, 7 aa, Artificial
  Consensus peptide
RVLNETR

SEQ ID NO: 286 - protein, 7 aa, Artificial
  Consensus peptide
VLNETRS

SEQ ID NO: 287 - protein, 7 aa, Artificial
  Consensus peptide
VLNETRN

SEQ ID NO: 288 - protein, 7 aa, Artificial
  Consensus peptide
LNETRSQ

SEQ ID NO: 289 - protein, 7 aa, Artificial
  Consensus peptide
LNETRNQ

SEQ ID NO: 290 - protein, 7 aa, Artificial
  Consensus peptide
NETRSQY

SEQ ID NO: 291 - protein, 7 aa, Artificial
  Consensus peptide
NETRNQY

SEQ ID NO: 292 - protein, 7 aa, Artificial
  Consensus peptide
ETRSQYE

SEQ ID NO: 293 - protein, 7 aa, Artificial
  Consensus peptide
ETRNQYE

SEQ ID NO: 294 - protein, 7 aa, Artificial
  Consensus peptide
TRSQYEA

SEQ ID NO: 295 - protein, 7 aa, Artificial
  Consensus peptide
TRNQYEA

SEQ ID NO: 296 - protein, 7 aa, Artificial
  Consensus peptide
RSQYEAL

SEQ ID NO: 297 - protein, 7 aa, Artificial
  Consensus peptide
RNQYEAL

SEQ ID NO: 298 - protein, 8 aa, Artificial
  Consensus peptide
EVNTLRCQ

SEQ ID NO: 299 - protein, 8 aa, Artificial
  Consensus peptide
EVNTLRCP

SEQ ID NO: 300 - protein, 8 aa, Artificial
  Consensus peptide
EVNTLRSQ

SEQ ID NO: 301 - protein, 8 aa, Artificial
  Consensus peptide
EVNTLRSP

SEQ ID NO: 302 - protein, 8 aa, Artificial
  Consensus peptide
VNTLRCQL

SEQ ID NO: 303 - protein, 8 aa, Artificial
  Consensus peptide
VNTLRCPL

SEQ ID NO: 304 - protein, 8 aa, Artificial
  Consensus peptide
VNTLRSQL

SEQ ID NO: 305 - protein, 8 aa, Artificial
  Consensus peptide
VNTLRSPL

SEQ ID NO: 306 - protein, 8 aa, Artificial
  Consensus peptide
NTLRCQLG

SEQ ID NO: 307 - protein, 8 aa, Artificial
  Consensus peptide
NTLRCPLG

SEQ ID NO: 308 - protein, 8 aa, Artificial
  Consensus peptide
NTLRSQLG

SEQ ID NO: 309 - protein, 8 aa, Artificial
  Consensus peptide
NTLRSPLG

SEQ ID NO: 310 - protein, 8 aa, Artificial
  Consensus peptide
TLRCQLGD

SEQ ID NO: 311 - protein, 8 aa, Artificial
  Consensus peptide
TLRCPLGD

SEQ ID NO: 312 - protein, 8 aa, Artificial
  Consensus peptide
TLRSQLGD

SEQ ID NO: 313 - protein, 8 aa, Artificial
  Consensus peptide
TLRSPLGD

SEQ ID NO: 314 - protein, 8 aa, Artificial
  Consensus peptide
LRCQLGDR

SEQ ID NO: 315 - protein, 8 aa, Artificial
  Consensus peptide
LRCPLGDR

SEQ ID NO: 316 - protein, 8 aa, Artificial
  Consensus peptide
LRSQLGDR

SEQ ID NO: 317 - protein, 8 aa, Artificial
  Consensus peptide
LRSPLGDR

SEQ ID NO: 318 - protein, 8 aa, Artificial
  Consensus peptide
RCQLGDRL

SEQ ID NO: 319 - protein, 8 aa, Artificial
  Consensus peptide
RCPLGDRL

SEQ ID NO: 320 - protein, 8 aa, Artificial
  Consensus peptide
RSQLGDRL

SEQ ID NO: 321 - protein, 8 aa, Artificial
  Consensus peptide
RSPLGDRL

SEQ ID NO: 322 - protein, 8 aa, Artificial
  Consensus peptide
CQLGDRLN

SEQ ID NO: 323 - protein, 8 aa, Artificial
  Consensus peptide
CPLGDRLN

SEQ ID NO: 324 - protein, 8 aa, Artificial
  Consensus peptide
SQLGDRLN

SEQ ID NO: 325 - protein, 8 aa, Artificial
  Consensus peptide
SPLGDRLN

SEQ ID NO: 326 - protein, 8 aa, Artificial
  Consensus peptide
QLGDRLNV

SEQ ID NO: 327 - protein, 8 aa, Artificial
  Consensus peptide
PLGDRLNV

SEQ ID NO: 328 - protein, 8 aa, Artificial
  Consensus peptide
LGDRLNVE

SEQ ID NO: 329 - protein, 8 aa, Artificial
  Consensus peptide
GDRLNVEV

SEQ ID NO: 330 - protein, 8 aa, Artificial
  Consensus peptide
DRLNVEVD

SEQ ID NO: 331 - protein, 8 aa, Artificial
  Consensus peptide
RLNVEVDA

SEQ ID NO: 332 - protein, 8 aa, Artificial
  Consensus peptide
RLNVEVDT

SEQ ID NO: 333 - protein, 8 aa, Artificial
  Consensus peptide
LNVEVDAA

SEQ ID NO: 334 - protein, 8 aa, Artificial
  Consensus peptide
LNVEVDTA

SEQ ID NO: 335 - protein, 8 aa, Artificial
  Consensus peptide
NVEVDAAP

SEQ ID NO: 336 - protein, 8 aa, Artificial
  Consensus peptide
NVEVDTAP

SEQ ID NO: 337 - protein, 8 aa, Artificial
  Consensus peptide
VEVDAAPT

SEQ ID NO: 338 - protein, 8 aa, Artificial
  Consensus peptide
VEVDTAPT

SEQ ID NO: 339 - protein, 8 aa, Artificial
  Consensus peptide
EVDAAPTV

SEQ ID NO: 340 - protein, 8 aa, Artificial
  Consensus peptide
EVDTAPTV

SEQ ID NO: 341 - protein, 8 aa, Artificial
  Consensus peptide
VDAAPTVD

SEQ ID NO: 342 - protein, 8 aa, Artificial
  Consensus peptide
VDTAPTVD

SEQ ID NO: 343 - protein, 8 aa, Artificial
  Consensus peptide
DAAPTVDL

SEQ ID NO: 344 - protein, 8 aa, Artificial
  Consensus peptide
DTAPTVDL

SEQ ID NO: 345 - protein, 8 aa, Artificial
  Consensus peptide
AAPTVDLN

SEQ ID NO: 346 - protein, 8 aa, Artificial
  Consensus peptide
TAPTVDLN

SEQ ID NO: 347 - protein, 8 aa, Artificial
  Consensus peptide
APTVDLNQ

SEQ ID NO: 348 - protein, 8 aa, Artificial
  Consensus peptide
APTVDLNR

SEQ ID NO: 349 - protein, 8 aa, Artificial
  Consensus peptide
PTVDLNQV

SEQ ID NO: 350 - protein, 8 aa, Artificial
  Consensus peptide
PTVDLNRV

SEQ ID NO: 351 - protein, 8 aa, Artificial
  Consensus peptide
TVDLNQVL

SEQ ID NO: 352 - protein, 8 aa, Artificial
  Consensus peptide
TVDLNRVL

SEQ ID NO: 353 - protein, 8 aa, Artificial
  Consensus peptide
VDLNQVLN

SEQ ID NO: 354 - protein, 8 aa, Artificial
  Consensus peptide
VDLNRVLN

SEQ ID NO: 355 - protein, 8 aa, Artificial
  Consensus peptide
DLNQVLNE

SEQ ID NO: 356 - protein, 8 aa, Artificial
  Consensus peptide
DLNRVLNE

SEQ ID NO: 357 - protein, 8 aa, Artificial
  Consensus peptide
LNQVLNET

SEQ ID NO: 358 - protein, 8 aa, Artificial
  Consensus peptide
LNRVLNET

SEQ ID NO: 359 - protein, 8 aa, Artificial
  Consensus peptide
NQVLNETR

SEQ ID NO: 360 - protein, 8 aa, Artificial
  Consensus peptide
NRVLNETR

SEQ ID NO: 361 - protein, 8 aa, Artificial
  Consensus peptide
QVLNETRS

SEQ ID NO: 362 - protein, 8 aa, Artificial
  Consensus peptide
QVLNETRN

SEQ ID NO: 363 - protein, 8 aa, Artificial
  Consensus peptide
RVLNETRS

SEQ ID NO: 364 - protein, 8 aa, Artificial
  Consensus peptide
RVLNETRN

SEQ ID NO: 365 - protein, 8 aa, Artificial
  Consensus peptide
VLNETRSQ

SEQ ID NO: 366 - protein, 8 aa, Artificial
  Consensus peptide
VLNETRNQ

SEQ ID NO: 367 - protein, 8 aa, Artificial
  Consensus peptide
LNETRSQY

SEQ ID NO: 368 - protein, 8 aa, Artificial
  Consensus peptide
LNETRNQY

SEQ ID NO: 369 - protein, 8 aa, Artificial
  Consensus peptide
NETRSQYE

SEQ ID NO: 370 - protein, 8 aa, Artificial
  Consensus peptide
NETRNQYE

SEQ ID NO: 371 - protein, 8 aa, Artificial
  Consensus peptide
ETRSQYEA

SEQ ID NO: 372 - protein, 8 aa, Artificial
  Consensus peptide
ETRNQYEA

SEQ ID NO: 373 - protein, 8 aa, Artificial
  Consensus peptide
TRSQYEAL

SEQ ID NO: 374 - protein, 8 aa, Artificial
  Consensus peptide
TRNQYEAL

SEQ ID NO: 375 - protein, 9 aa, Artificial
  Consensus peptide
EVNTLRCQL

SEQ ID NO: 376 - protein, 9 aa, Artificial
  Consensus peptide
EVNTLRCPL

SEQ ID NO: 377 - protein, 9 aa, Artificial
  Consensus peptide
EVNTLRSQL

SEQ ID NO: 378 - protein, 9 aa, Artificial
  Consensus peptide
EVNTLRSPL

SEQ ID NO: 379 - protein, 9 aa, Artificial
  Consensus peptide
VNTLRCQLG

SEQ ID NO: 380 - protein, 9 aa, Artificial
  Consensus peptide
VNTLRCPLG

SEQ ID NO: 381 - protein, 9 aa, Artificial
  Consensus peptide
VNTLRSQLG

SEQ ID NO: 382 - protein, 9 aa, Artificial
  Consensus peptide
VNTLRSPLG

SEQ ID NO: 383 - protein, 9 aa, Artificial
  Consensus peptide
NTLRCQLGD

SEQ ID NO: 384 - protein, 9 aa, Artificial
  Consensus peptide
NTLRCPLGD

SEQ ID NO: 385 - protein, 9 aa, Artificial
  Consensus peptide
NTLRSQLGD

SEQ ID NO: 386 - protein, 9 aa, Artificial
  Consensus peptide
NTLRSPLGD

SEQ ID NO: 387 - protein, 9 aa, Artificial
  Consensus peptide
TLRCQLGDR

SEQ ID NO: 388 - protein, 9 aa, Artificial
  Consensus peptide
TLRCPLGDR

SEQ ID NO: 389 - protein, 9 aa, Artificial
  Consensus peptide
TLRSQLGDR

SEQ ID NO: 390 - protein, 9 aa, Artificial
  Consensus peptide
TLRSPLGDR

SEQ ID NO: 391 - protein, 9 aa, Artificial
  Consensus peptide
LRCQLGDRL

SEQ ID NO: 392 - protein, 9 aa, Artificial
  Consensus peptide
LRCPLGDRL

SEQ ID NO: 393 - protein, 9 aa, Artificial
  Consensus peptide
LRSQLGDRL

SEQ ID NO: 394 - protein, 9 aa, Artificial
  Consensus peptide
LRSPLGDRL

SEQ ID NO: 395 - protein, 9 aa, Artificial
  Consensus peptide
RCQLGDRLN

SEQ ID NO: 396 - protein, 9 aa, Artificial
  Consensus peptide
RCPLGDRLN

SEQ ID NO: 397 - protein, 9 aa, Artificial
  Consensus peptide
RSQLGDRLN

SEQ ID NO: 398 - protein, 9 aa, Artificial
  Consensus peptide
RSPLGDRLN

SEQ ID NO: 399 - protein, 9 aa, Artificial
  Consensus peptide
CQLGDRLNV

SEQ ID NO: 400 - protein, 9 aa, Artificial
  Consensus peptide
CPLGDRLNV

SEQ ID NO: 401 - protein, 9 aa, Artificial
  Consensus peptide
SQLGDRLNV

SEQ ID NO: 402 - protein, 9 aa, Artificial
  Consensus peptide
SPLGDRLNV

SEQ ID NO: 403 - protein, 9 aa, Artificial
  Consensus peptide
QLGDRLNVE

SEQ ID NO: 404 - protein, 9 aa, Artificial
  Consensus peptide
PLGDRLNVE

SEQ ID NO: 405 - protein, 9 aa, Artificial
  Consensus peptide
LGDRLNVEV

SEQ ID NO: 406 - protein, 9 aa, Artificial
  Consensus peptide
GDRLNVEVD

SEQ ID NO: 407 - protein, 9 aa, Artificial
  Consensus peptide
DRLNVEVDA

SEQ ID NO: 408 - protein, 9 aa, Artificial
  Consensus peptide
DRLNVEVDT

SEQ ID NO: 409 - protein, 9 aa, Artificial
  Consensus peptide
RLNVEVDAA

SEQ ID NO: 410 - protein, 9 aa, Artificial
  Consensus peptide
RLNVEVDTA

SEQ ID NO: 411 - protein, 9 aa, Artificial
  Consensus peptide
LNVEVDAAP

SEQ ID NO: 412 - protein, 9 aa, Artificial
  Consensus peptide
LNVEVDTAP

SEQ ID NO: 413 - protein, 9 aa, Artificial
  Consensus peptide
NVEVDTAPT

SEQ ID NO: 414 - protein, 9 aa, Artificial
  Consensus peptide
NVEVDAAPT

SEQ ID NO: 415 - protein, 9 aa, Artificial
  Consensus peptide
VEVDAAPTV

SEQ ID NO: 416 - protein, 9 aa, Artificial
  Consensus peptide
VEVDTAPTV

SEQ ID NO: 417 - protein, 9 aa, Artificial
  Consensus peptide
EVDAAPTVD

SEQ ID NO: 418 - protein, 9 aa, Artificial
  Consensus peptide
EVDTAPTVD

SEQ ID NO: 419 - protein, 9 aa, Artificial
  Consensus peptide
VDAAPTVDL

SEQ ID NO: 420 - protein, 9 aa, Artificial
  Consensus peptide
VDTAPTVDL

SEQ ID NO: 421 - protein, 9 aa, Artificial
  Consensus peptide
DAAPTVDLN

SEQ ID NO: 422 - protein, 9 aa, Artificial
  Consensus peptide
DTAPTVDLN

SEQ ID NO: 423 - protein, 9 aa, Artificial
  Consensus peptide
AAPTVDLNQ

SEQ ID NO: 424 - protein, 9 aa, Artificial
  Consensus peptide
AAPTVDLNR

SEQ ID NO: 425 - protein, 9 aa, Artificial
  Consensus peptide
TAPTVDLNQ

SEQ ID NO: 426 - protein, 9 aa, Artificial
  Consensus peptide
TAPTVDLNR

SEQ ID NO: 427 - protein, 9 aa, Artificial
  Consensus peptide
APTVDLNQV

SEQ ID NO: 428 - protein, 9 aa, Artificial
  Consensus peptide
APTVDLNRV

SEQ ID NO: 429 - protein, 9 aa, Artificial
  Consensus peptide
PTVDLNQVL

SEQ ID NO: 430 - protein, 9 aa, Artificial
  Consensus peptide
PTVDLNRVL

SEQ ID NO: 431 - protein, 9 aa, Artificial
  Consensus peptide
TVDLNQVLN

SEQ ID NO: 432 - protein, 9 aa, Artificial
  Consensus peptide
TVDLNRVLN

SEQ ID NO: 433 - protein, 9 aa, Artificial
  Consensus peptide
VDLNQVLNE

SEQ ID NO: 434 - protein, 9 aa, Artificial
  Consensus peptide
VDLNRVLNE

SEQ ID NO: 435 - protein, 9 aa, Artificial
  Consensus peptide
DLNQVLNET

SEQ ID NO: 436 - protein, 9 aa, Artificial
  Consensus peptide
DLNRVLNET

SEQ ID NO: 437 - protein, 9 aa, Artificial
  Consensus peptide
LNQVLNETR

SEQ ID NO: 438 - protein, 9 aa, Artificial
  Consensus peptide
LNRVLNETR

SEQ ID NO: 439 - protein, 9 aa, Artificial
  Consensus peptide
NQVLNETRS

SEQ ID NO: 440 - protein, 9 aa, Artificial
  Consensus peptide
NQVLNETRN

SEQ ID NO: 441 - protein, 9 aa, Artificial
  Consensus peptide
NRVLNETRS

SEQ ID NO: 442 - protein, 9 aa, Artificial
  Consensus peptide
NRVLNETRN

SEQ ID NO: 443 - protein, 9 aa, Artificial
  Consensus peptide
QVLNETRSQ

SEQ ID NO: 444 - protein, 9 aa, Artificial
  Consensus peptide
QVLNETRNQ

SEQ ID NO: 445 - protein, 9 aa, Artificial
  Consensus peptide
RVLNETRSQ

SEQ ID NO: 446 - protein, 9 aa, Artificial
  Consensus peptide
RVLNETRNQ

SEQ ID NO: 447 - protein, 9 aa, Artificial
  Consensus peptide
VLNETRSQY

SEQ ID NO: 448 - protein, 9 aa, Artificial
  Consensus peptide
VLNETRNQY

SEQ ID NO: 449 - protein, 9 aa, Artificial
  Consensus peptide
LNETRSQYE

SEQ ID NO: 450 - protein, 9 aa, Artificial
  Consensus peptide
LNETRNQYE

SEQ ID NO: 451 - protein, 9 aa, Artificial
  Consensus peptide
NETRSQYEA

SEQ ID NO: 452 - protein, 9 aa, Artificial
  Consensus peptide
NETRNQYEA

SEQ ID NO: 453 - protein, 9 aa, Artificial
  Consensus peptide
ETRSQYEAL

SEQ ID NO: 454 - protein, 9 aa, Artificial
  Consensus peptide
ETRNQYEAL

SEQ ID NO: 455 - protein, 10 aa, Artificial
  Consensus peptide
EVNTLRCQLG

SEQ ID NO: 456 - protein, 10 aa, Artificial
  Consensus peptide
EVNTLRCPLG

SEQ ID NO: 457 - protein, 10 aa, Artificial
  Consensus peptide
EVNTLRSQLG

SEQ ID NO: 458 - protein, 10 aa, Artificial
  Consensus peptide
EVNTLRSPLG

SEQ ID NO: 459 - protein, 10 aa, Artificial
  Consensus peptide
VNTLRCQLGD

SEQ ID NO: 460 - protein, 10 aa, Artificial
  Consensus peptide
VNTLRCPLGD

SEQ ID NO: 461 - protein, 10 aa, Artificial
  Consensus peptide
VNTLRSQLGD

SEQ ID NO: 462 - protein, 10 aa, Artificial
  Consensus peptide
VNTLRSPLGD

SEQ ID NO: 463 - protein, 10 aa, Artificial
  Consensus peptide
NTLRCQLGDR

SEQ ID NO: 464 - protein, 10 aa, Artificial
  Consensus peptide
NTLRCPLGDR

SEQ ID NO: 465 - protein, 10 aa, Artificial
  Consensus peptide
NTLRSQLGDR

SEQ ID NO: 466 - protein, 10 aa, Artificial
  Consensus peptide
NTLRSPLGDR

SEQ ID NO: 467 - protein, 10 aa, Artificial
  Consensus peptide
TLRCQLGDRL

SEQ ID NO: 468 - protein, 10 aa, Artificial
  Consensus peptide
TLRCPLGDRL

SEQ ID NO: 469 - protein, 10 aa, Artificial
  Consensus peptide
TLRSQLGDRL

SEQ ID NO: 470 - protein, 10 aa, Artificial
  Consensus peptide
TLRSPLGDRL

SEQ ID NO: 471 - protein, 10 aa, Artificial
  Consensus peptide
LRCQLGDRLN

SEQ ID NO: 472 - protein, 10 aa, Artificial
  Consensus peptide
LRCPLGDRLN

SEQ ID NO: 473 - protein, 10 aa, Artificial
  Consensus peptide
LRSQLGDRLN

SEQ ID NO: 474 - protein, 10 aa, Artificial
  Consensus peptide
LRSPLGDRLN

SEQ ID NO: 475 - protein, 10 aa, Artificial
  Consensus peptide
RCQLGDRLNV

SEQ ID NO: 476 - protein, 10 aa, Artificial
  Consensus peptide
RCPLGDRLNV

SEQ ID NO: 477 - protein, 10 aa, Artificial
  Consensus peptide
RSQLGDRLNV

SEQ ID NO: 478 - protein, 10 aa, Artificial
  Consensus peptide
RSPLGDRLNV

SEQ ID NO: 479 - protein, 10 aa, Artificial
  Consensus peptide
CQLGDRLNVE

SEQ ID NO: 480 - protein, 10 aa, Artificial
  Consensus peptide
CPLGDRLNVE

SEQ ID NO: 481 - protein, 10 aa, Artificial
  Consensus peptide
SQLGDRLNVE

SEQ ID NO: 482 - protein, 10 aa, Artificial
  Consensus peptide
SPLGDRLNVE

SEQ ID NO: 483 - protein, 10 aa, Artificial
  Consensus peptide
QLGDRLNVEV

SEQ ID NO: 484 - protein, 10 aa, Artificial
  Consensus peptide
PLGDRLNVEV

SEQ ID NO: 485 - protein, 10 aa, Artificial
  Consensus peptide
LGDRLNVEVD

SEQ ID NO: 486 - protein, 10 aa, Artificial
  Consensus peptide
GDRLNVEVDA

SEQ ID NO: 487 - protein, 10 aa, Artificial
  Consensus peptide
GDRLNVEVDT

SEQ ID NO: 488 - protein, 10 aa, Artificial
  Consensus peptide
DRLNVEVDAA

SEQ ID NO: 489 - protein, 10 aa, Artificial
  Consensus peptide
DRLNVEVDTA

SEQ ID NO: 490 - protein, 10 aa, Artificial
  Consensus peptide
RLNVEVDAAP

SEQ ID NO: 491 - protein, 10 aa, Artificial
  Consensus peptide
RLNVEVDTAP

SEQ ID NO: 492 - protein, 10 aa, Artificial
  Consensus peptide
LNVEVDAAPT

SEQ ID NO: 493 - protein, 10 aa, Artificial
  Consensus peptide
LNVEVDTAPT

SEQ ID NO: 494 - protein, 10 aa, Artificial
  Consensus peptide
NVEVDAAPTV

SEQ ID NO: 495 - protein, 10 aa, Artificial
  Consensus peptide
NVEVDTAPTV

SEQ ID NO: 496 - protein, 10 aa, Artificial
  Consensus peptide
VEVDAAPTVD

SEQ ID NO: 497 - protein, 10 aa, Artificial
  Consensus peptide
VEVDTAPTVD

SEQ ID NO: 498 - protein, 10 aa, Artificial
  Consensus peptide
EVDAAPTVDL

SEQ ID NO: 499 - protein, 10 aa, Artificial
  Consensus peptide
EVDTAPTVDL

SEQ ID NO: 500 - protein, 10 aa, Artificial
  Consensus peptide
VDAAPTVDLN

SEQ ID NO: 501 - protein, 10 aa, Artificial
  Consensus peptide
VDTAPTVDLN

SEQ ID NO: 502 - protein, 10 aa, Artificial
  Consensus peptide
DAAPTVDLNR

SEQ ID NO: 503 - protein, 10 aa, Artificial
  Consensus peptide
DAAPTVDLNQ

SEQ ID NO: 504 - protein, 10 aa, Artificial
  Consensus peptide
DTAPTVDLNR

SEQ ID NO: 505 - protein, 10 aa, Artificial
  Consensus peptide
DTAPTVDLNQ

SEQ ID NO: 506 - protein, 10 aa, Artificial
  Consensus peptide
AAPTVDLNQV

SEQ ID NO: 507 - protein, 10 aa, Artificial
  Consensus peptide
AAPTVDLNRV

SEQ ID NO: 508 - protein, 10 aa, Artificial
  Consensus peptide
TAPTVDLNQV

SEQ ID NO: 509 - protein, 10 aa, Artificial
  Consensus peptide
TAPTVDLNRV

SEQ ID NO: 510 - protein, 10 aa, Artificial
  Consensus peptide
APTVDLNQVL

SEQ ID NO: 511 - protein, 10 aa, Artificial
  Consensus peptide
APTVDLNRVL

SEQ ID NO: 512 - protein, 10 aa, Artificial
  Consensus peptide
PTVDLNQVLN

SEQ ID NO: 513 - protein, 10 aa, Artificial
  Consensus peptide
PTVDLNRVLN

SEQ ID NO: 514 - protein, 10 aa, Artificial
  Consensus peptide
TVDLNQVLNE

SEQ ID NO: 515 - protein, 10 aa, Artificial
  Consensus peptide
TVDLNRVLNE

SEQ ID NO: 516 - protein, 10 aa, Artificial
  Consensus peptide
VDLNQVLNET

SEQ ID NO: 517 - protein, 10 aa, Artificial
  Consensus peptide
VDLNRVLNET

SEQ ID NO: 518 - protein, 10 aa, Artificial
  Consensus peptide
DLNQVLNETR

SEQ ID NO: 519 - protein, 10 aa, Artificial
  Consensus peptide
DLNRVLNETR

SEQ ID NO: 520 - protein, 10 aa, Artificial
  Consensus peptide
LNQVLNETRS

SEQ ID NO: 521 - protein, 10 aa, Artificial
  Consensus peptide
LNQVLNETRN

SEQ ID NO: 522 - protein, 10 aa, Artificial
  Consensus peptide
LNRVLNETRS

SEQ ID NO: 523 - protein, 10 aa, Artificial
  Consensus peptide
LNRVLNETRN

SEQ ID NO: 524 - protein, 10 aa, Artificial
  Consensus peptide
NQVLNETRSQ

SEQ ID NO: 525 - protein, 10 aa, Artificial
  Consensus peptide
NQVLNETRNQ

SEQ ID NO: 526 - protein, 10 aa, Artificial
  Consensus peptide
NRVLNETRSQ

SEQ ID NO: 527 - protein, 10 aa, Artificial
  Consensus peptide
NRVLNETRNQ

SEQ ID NO: 528 - protein, 10 aa, Artificial
  Consensus peptide
QVLNETRSQY

SEQ ID NO: 529 - protein, 10 aa, Artificial
  Consensus peptide
QVLNETRNQY

SEQ ID NO: 530 - protein, 10 aa, Artificial
  Consensus peptide
RVLNETRSQY

SEQ ID NO: 531 - protein, 10 aa, Artificial
  Consensus peptide
RVLNETRNQY

SEQ ID NO: 532 - protein, 10 aa, Artificial
  Consensus peptide
QVLNETRSQY

SEQ ID NO: 533 - protein, 10 aa, Artificial
  Consensus peptide
QVLNETRNQY

SEQ ID NO: 534 - protein, 10 aa, Artificial
  Consensus peptide
RVLNETRSQY

SEQ ID NO: 535 - protein, 10 aa, Artificial
  Consensus peptide
RVLNETRNQY

SEQ ID NO: 536 - protein, 10 aa, Artificial
  Consensus peptide
VLNETRSQYE

SEQ ID NO: 537 - protein, 10 aa, Artificial
  Consensus peptide
VLNETRNQYE

SEQ ID NO: 538 - protein, 10 aa, Artificial
  Consensus peptide
LNETRSQYEA

SEQ ID NO: 539 - protein, 10 aa, Artificial
  Consensus peptide
LNETRNQYEA

SEQ ID NO: 540 - protein, 10 aa, Artificial
  Consensus peptide
NETRSQYEAL

SEQ ID NO: 541 - protein, 10 aa, Artificial
  Consensus peptide
NETRNQYEAL

SEQ ID NO: 542 - protein, 11 aa, Artificial
  Consensus peptide
EVNTLRCQLGD

SEQ ID NO: 543 - protein, 11 aa, Artificial
  Consensus peptide
EVNTLRCPLGD

SEQ ID NO: 544 - protein, 11 aa, Artificial
  Consensus peptide
EVNTLRSQLGD

SEQ ID NO: 545 - protein, 11 aa, Artificial
  Consensus peptide
EVNTLRSPLGD

SEQ ID NO: 546 - protein, 11 aa, Artificial
  Consensus peptide
VNTLRCQLGDR

SEQ ID NO: 547 - protein, 11 aa, Artificial
  Consensus peptide
VNTLRCPLGDR

SEQ ID NO: 548 - protein, 11 aa, Artificial
  Consensus peptide
VNTLRSQLGDR

SEQ ID NO: 549 - protein, 11 aa, Artificial
  Consensus peptide
VNTLRSPLGDR

SEQ ID NO: 550 - protein, 11 aa, Artificial
  Consensus peptide
NTLRCQLGDRL

SEQ ID NO: 551 - protein, 11 aa, Artificial
  Consensus peptide
NTLRCPLGDRL

SEQ ID NO: 552 - protein, 11 aa, Artificial
  Consensus peptide
NTLRSQLGDRL

SEQ ID NO: 553 - protein, 11 aa, Artificial
  Consensus peptide
NTLRSPLGDRL

SEQ ID NO: 554 - protein, 11 aa, Artificial
  Consensus peptide
TLRCQLGDRLN

SEQ ID NO: 555 - protein, 11 aa, Artificial
  Consensus peptide
TLRCPLGDRLN

SEQ ID NO: 556 - protein, 11 aa, Artificial
  Consensus peptide
TLRSQLGDRLN

SEQ ID NO: 557 - protein, 11 aa, Artificial
  Consensus peptide
TLRSPLGDRLN

SEQ ID NO: 558 - protein, 11 aa, Artificial
  Consensus peptide
LRCQLGDRLNV

SEQ ID NO: 559 - protein, 11 aa, Artificial
  Consensus peptide
LRCPLGDRLNV

SEQ ID NO: 560 - protein, 11 aa, Artificial
  Consensus peptide
LRSQLGDRLNV

SEQ ID NO: 561 - protein, 11 aa, Artificial
  Consensus peptide
LRSPLGDRLNV

SEQ ID NO: 562 - protein, 11 aa, Artificial
  Consensus peptide
RCQLGDRLNVE

SEQ ID NO: 563 - protein, 11 aa, Artificial
  Consensus peptide
RCPLGDRLNVE

SEQ ID NO: 564 - protein, 11 aa, Artificial
  Consensus peptide
RSQLGDRLNVE

SEQ ID NO: 565 - protein, 11 aa, Artificial
  Consensus peptide
RSPLGDRLNVE

SEQ ID NO: 566 - protein, 11 aa, Artificial
  Consensus peptide
CQLGDRLNVEV

SEQ ID NO: 567 - protein, 11 aa, Artificial
  Consensus peptide
CPLGDRLNVEV

SEQ ID NO: 568 - protein, 11 aa, Artificial
  Consensus peptide
SQLGDRLNVEV

SEQ ID NO: 569 - protein, 11 aa, Artificial
  Consensus peptide
SPLGDRLNVEV

SEQ ID NO: 570 - protein, 11 aa, Artificial
  Consensus peptide
QLGDRLNVEVD

SEQ ID NO: 571 - protein, 11 aa, Artificial
  Consensus peptide
PLGDRLNVEVD

SEQ ID NO: 572 - protein, 11 aa, Artificial
  Consensus peptide
LGDRLNVEVDA

SEQ ID NO: 573 - protein, 11 aa, Artificial
  Consensus peptide
LGDRLNVEVDT

SEQ ID NO: 574 - protein, 11 aa, Artificial
  Consensus peptide
GDRLNVEVDAA

SEQ ID NO: 575 - protein, 11 aa, Artificial
  Consensus peptide
GDRLNVEVDTA

SEQ ID NO: 576 - protein, 11 aa, Artificial
  Consensus peptide
DRLNVEVDAAP

SEQ ID NO: 577 - protein, 11 aa, Artificial
  Consensus peptide
DRLNVEVDTAP

SEQ ID NO: 578 - protein, 11 aa, Artificial
  Consensus peptide
RLNVEVDAAPT

SEQ ID NO: 579 - protein, 11 aa, Artificial
  Consensus peptide
RLNVEVDTAPT

SEQ ID NO: 580 - protein, 11 aa, Artificial
  Consensus peptide
LNVEVDAAPTV

SEQ ID NO: 581 - protein, 11 aa, Artificial
  Consensus peptide
LNVEVDTAPTV

SEQ ID NO: 582 - protein, 11 aa, Artificial
  Consensus peptide
NVEVDAAPTVD

SEQ ID NO: 583 - protein, 11 aa, Artificial
  Consensus peptide
NVEVDTAPTVD

SEQ ID NO: 584 - protein, 11 aa, Artificial
  Consensus peptide
VEVDAAPTVDL

SEQ ID NO: 585 - protein, 11 aa, Artificial
  Consensus peptide
VEVDTAPTVDL

SEQ ID NO: 586 - protein, 11 aa, Artificial
  Consensus peptide
EVDAAPTVDLN

SEQ ID NO: 587 - protein, 11 aa, Artificial
  Consensus peptide
EVDTAPTVDLN

SEQ ID NO: 588 - protein, 11 aa, Artificial
  Consensus peptide
VDAAPTVDLNQ

SEQ ID NO: 589 - protein, 11 aa, Artificial
  Consensus peptide
VDAAPTVDLNR

SEQ ID NO: 590 - protein, 11 aa, Artificial
  Consensus peptide
VDTAPTVDLNQ

SEQ ID NO: 591 - protein, 11 aa, Artificial
  Consensus peptide
VDTAPTVDLNR

SEQ ID NO: 592 - protein, 11 aa, Artificial
  Consensus peptide
DAAPTVDLNQV

SEQ ID NO: 593 - protein, 11 aa, Artificial
  Consensus peptide
DAAPTVDLNRV

SEQ ID NO: 594 - protein, 11 aa, Artificial
  Consensus peptide
DTAPTVDLNQV

SEQ ID NO: 595 - protein, 11 aa, Artificial
  Consensus peptide
DTAPTVDLNRV

SEQ ID NO: 596 - protein, 11 aa, Artificial
  Consensus peptide
AAPTVDLNQVL

SEQ ID NO: 597 - protein, 11 aa, Artificial
  Consensus peptide
AAPTVDLNRVL

SEQ ID NO: 598 - protein, 11 aa, Artificial
  Consensus peptide
TAPTVDLNQVL

SEQ ID NO: 599 - protein, 11 aa, Artificial
  Consensus peptide
TAPTVDLNRVL

SEQ ID NO: 600 - protein, 11 aa, Artificial
  Consensus peptide
APTVDLNQVLN

SEQ ID NO: 601 - protein, 11 aa, Artificial
  Consensus peptide
APTVDLNRVLN

SEQ ID NO: 602 - protein, 11 aa, Artificial
  Consensus peptide
PTVDLNQVLNE

SEQ ID NO: 603 - protein, 11 aa, Artificial
  Consensus peptide
PTVDLNRVLNE

SEQ ID NO: 604 - protein, 11 aa, Artificial
  Consensus peptide
TVDLNQVLNET

SEQ ID NO: 605 - protein, 11 aa, Artificial
  Consensus peptide
TVDLNRVLNET

SEQ ID NO: 606 - protein, 11 aa, Artificial
  Consensus peptide
VDLNQVLNETR

SEQ ID NO: 607 - protein, 11 aa, Artificial
  Consensus peptide
VDLNRVLNETR

SEQ ID NO: 608 - protein, 11 aa, Artificial
  Consensus peptide
DLNQVLNETRS

SEQ ID NO: 609 - protein, 11 aa, Artificial
  Consensus peptide
DLNQVLNETRN

SEQ ID NO: 610 - protein, 11 aa, Artificial
  Consensus peptide
DLNRVLNETRS

SEQ ID NO: 611 - protein, 11 aa, Artificial
  Consensus peptide
DLNRVLNETRN

SEQ ID NO: 612 - protein, 11 aa, Artificial
  Consensus peptide
LNQVLNETRSQ

SEQ ID NO: 613 - protein, 11 aa, Artificial
  Consensus peptide
LNQVLNETRNQ

SEQ ID NO: 614 - protein, 11 aa, Artificial
  Consensus peptide
LNRVLNETRSQ

SEQ ID NO: 615 - protein, 11 aa, Artificial
  Consensus peptide
LNRVLNETRNQ

SEQ ID NO: 616 - protein, 11 aa, Artificial
  Consensus peptide
NQVLNETRSQY

SEQ ID NO: 617 - protein, 11 aa, Artificial
  Consensus peptide
NQVLNETRNQY

SEQ ID NO: 618 - protein, 11 aa, Artificial
  Consensus peptide
NRVLNETRSQY

SEQ ID NO: 619 - protein, 11 aa, Artificial
  Consensus peptide
NRVLNETRNQY

SEQ ID NO: 620 - protein, 11 aa, Artificial
  Consensus peptide
QVLNETRSQYE

SEQ ID NO: 621 - protein, 11 aa, Artificial
  Consensus peptide
QVLNETRNQYE

SEQ ID NO: 622 - protein, 11 aa, Artificial
  Consensus peptide
RVLNETRSQYE

SEQ ID NO: 623 - protein, 11 aa, Artificial
  Consensus peptide
RVLNETRNQYE

SEQ ID NO: 624 - protein, 11 aa, Artificial
  Consensus peptide
VLNETRSQYEA

SEQ ID NO: 625 - protein, 11 aa, Artificial
  Consensus peptide
VLNETRNQYEA

SEQ ID NO: 626 - protein, 11 aa, Artificial
  Consensus peptide
LNETRSQYEAL

SEQ ID NO: 627 - protein, 11 aa, Artificial
  Consensus peptide
LNETRNQYEAL

SEQ ID NO: 628 - protein, 12 aa, Artificial
  Consensus peptide
EVNTLRCQLGDR

SEQ ID NO: 629 - protein, 12 aa, Artificial
  Consensus peptide
EVNTLRCPLGDR

SEQ ID NO: 630 - protein, 12 aa, Artificial
  Consensus peptide
EVNTLRSQLGDR

SEQ ID NO: 631 - protein, 12 aa, Artificial
  Consensus peptide
EVNTLRSPLGDR

SEQ ID NO: 632 - protein, 12 aa, Artificial
  Consensus peptide
VNTLRCQLGDRL

SEQ ID NO: 633 - protein, 12 aa, Artificial
  Consensus peptide
VNTLRCPLGDRL

SEQ ID NO: 634 - protein, 12 aa, Artificial
  Consensus peptide
VNTLRSQLGDRL

SEQ ID NO: 635 - protein, 12 aa, Artificial
  Consensus peptide
VNTLRSPLGDRL

SEQ ID NO: 636 - protein, 12 aa, Artificial
  Consensus peptide
NTLRCQLGDRLN

SEQ ID NO: 637 - protein, 12 aa, Artificial
  Consensus peptide
NTLRCPLGDRLN

SEQ ID NO: 638 - protein, 12 aa, Artificial
  Consensus peptide
NTLRSQLGDRLN

SEQ ID NO: 639 - protein, 12 aa, Artificial
  Consensus peptide
NTLRSPLGDRLN

SEQ ID NO: 640 - protein, 12 aa, Artificial
  Consensus peptide
TLRCQLGDRLNV

SEQ ID NO: 641 - protein, 12 aa, Artificial
  Consensus peptide
TLRCPLGDRLNV

SEQ ID NO: 642 - protein, 12 aa, Artificial
  Consensus peptide
TLRSQLGDRLNV

SEQ ID NO: 643 - protein, 12 aa, Artificial
  Consensus peptide
TLRSPLGDRLNV

SEQ ID NO: 644 - protein, 12 aa, Artificial
  Consensus peptide
LRCQLGDRLNVE

SEQ ID NO: 645 - protein, 12 aa, Artificial
  Consensus peptide
LRCPLGDRLNVE

SEQ ID NO: 646 - protein, 12 aa, Artificial
  Consensus peptide
LRSQLGDRLNVE

SEQ ID NO: 647 - protein, 12 aa, Artificial
  Consensus peptide
LRSPLGDRLNVE

SEQ ID NO: 648 - protein, 12 aa, Artificial
  Consensus peptide
RCQLGDRLNVEV

SEQ ID NO: 649 - protein, 12 aa, Artificial
  Consensus peptide
RCPLGDRLNVEV

SEQ ID NO: 650 - protein, 12 aa, Artificial
  Consensus peptide
RSQLGDRLNVEV

SEQ ID NO: 651 - protein, 12 aa, Artificial
  Consensus peptide
RSPLGDRLNVEV

SEQ ID NO: 652 - protein, 12 aa, Artificial
  Consensus peptide
CQLGDRLNVEVD

SEQ ID NO: 653 - protein, 12 aa, Artificial
  Consensus peptide
CPLGDRLNVEVD

SEQ ID NO: 654 - protein, 12 aa, Artificial
  Consensus peptide
SQLGDRLNVEVD

SEQ ID NO: 655 - protein, 12 aa, Artificial
  Consensus peptide
SPLGDRLNVEVD

SEQ ID NO: 656 - protein, 12 aa, Artificial
  Consensus peptide
QLGDRLNVEVDA

SEQ ID NO: 657 - protein, 12 aa, Artificial
  Consensus peptide
QLGDRLNVEVDT

SEQ ID NO: 658 - protein, 12 aa, Artificial
  Consensus peptide
PLGDRLNVEVDA

SEQ ID NO: 659 - protein, 12 aa, Artificial
  Consensus peptide
PLGDRLNVEVDT

SEQ ID NO: 660 - protein, 12 aa, Artificial
  Consensus peptide
LGDRLNVEVDAA

SEQ ID NO: 661 - protein, 12 aa, Artificial
  Consensus peptide
LGDRLNVEVDTA

SEQ ID NO: 662 - protein, 12 aa, Artificial
  Consensus peptide
GDRLNVEVDAAP

SEQ ID NO: 663 - protein, 12 aa, Artificial
  Consensus peptide
GDRLNVEVDTAP

SEQ ID NO: 664 - protein, 12 aa, Artificial
  Consensus peptide
DRLNVEVDAAPT

SEQ ID NO: 665 - protein, 12 aa, Artificial
  Consensus peptide
DRLNVEVDTAPT

SEQ ID NO: 666 - protein, 12 aa, Artificial
  Consensus peptide
RLNVEVDAAPTV

SEQ ID NO: 667 - protein, 12 aa, Artificial
  Consensus peptide
RLNVEVDTAPTV

SEQ ID NO: 668 - protein, 12 aa, Artificial
  Consensus peptide
LNVEVDAAPTVD

SEQ ID NO: 669 - protein, 12 aa, Artificial
  Consensus peptide
LNVEVDTAPTVD

SEQ ID NO: 670 - protein, 12 aa, Artificial
  Consensus peptide
NVEVDAAPTVDL

SEQ ID NO: 671 - protein, 12 aa, Artificial
  Consensus peptide
NVEVDTAPTVDL

SEQ ID NO: 672 - protein, 12 aa, Artificial
  Consensus peptide
VEVDAAPTVDLN

SEQ ID NO: 673 - protein, 12 aa, Artificial
  Consensus peptide
VEVDTAPTVDLN

SEQ ID NO: 674 - protein, 12 aa, Artificial
  Consensus peptide
EVDAAPTVDLNQ

SEQ ID NO: 675 - protein, 12 aa, Artificial
  Consensus peptide
EVDAAPTVDLNR

SEQ ID NO: 676 - protein, 12 aa, Artificial
  Consensus peptide
EVDTAPTVDLNQ

SEQ ID NO: 677 - protein, 12 aa, Artificial
  Consensus peptide
EVDTAPTVDLNR

SEQ ID NO: 678 - protein, 12 aa, Artificial
  Consensus peptide
VDAAPTVDLNQV

SEQ ID NO: 679 - protein, 12 aa, Artificial
  Consensus peptide
VDAAPTVDLNRV

SEQ ID NO: 680 - protein, 12 aa, Artificial
  Consensus peptide
VDTAPTVDLNQV

SEQ ID NO: 681 - protein, 12 aa, Artificial
  Consensus peptide
VDTAPTVDLNRV

SEQ ID NO: 682 - protein, 12 aa, Artificial
  Consensus peptide
DAAPTVDLNQVL

SEQ ID NO: 683 - protein, 12 aa, Artificial
  Consensus peptide
DAAPTVDLNRVL

SEQ ID NO: 684 - protein, 12 aa, Artificial
  Consensus peptide
DTAPTVDLNQVL

SEQ ID NO: 685 - protein, 12 aa, Artificial
  Consensus peptide
DTAPTVDLNRVL

SEQ ID NO: 686 - protein, 12 aa, Artificial
  Consensus peptide
AAPTVDLNQVLN

SEQ ID NO: 687 - protein, 12 aa, Artificial
  Consensus peptide
AAPTVDLNRVLN

SEQ ID NO: 688 - protein, 12 aa, Artificial
  Consensus peptide
TAPTVDLNQVLN

SEQ ID NO: 689 - protein, 12 aa, Artificial
  Consensus peptide
TAPTVDLNRVLN

SEQ ID NO: 690 - protein, 12 aa, Artificial
  Consensus peptide
APTVDLNQVLNE

SEQ ID NO: 691 - protein, 12 aa, Artificial
  Consensus peptide
APTVDLNRVLNE

SEQ ID NO: 692 - protein, 12 aa, Artificial
  Consensus peptide
PTVDLNQVLNET

SEQ ID NO: 693 - protein, 12 aa, Artificial
  Consensus peptide
PTVDLNRVLNET

SEQ ID NO: 694 - protein, 12 aa, Artificial
  Consensus peptide
TVDLNQVLNETR

SEQ ID NO: 695 - protein, 12 aa, Artificial
  Consensus peptide
TVDLNRVLNETR

SEQ ID NO: 696 - protein, 12 aa, Artificial
  Consensus peptide
VDLNQVLNETRS

SEQ ID NO: 697 - protein, 12 aa, Artificial
  Consensus peptide
VDLNQVLNETRN

SEQ ID NO: 698 - protein, 12 aa, Artificial
  Consensus peptide
VDLNRVLNETRS

SEQ ID NO: 699 - protein, 12 aa, Artificial
  Consensus peptide
VDLNRVLNETRN

SEQ ID NO: 700 - protein, 12 aa, Artificial
  Consensus peptide
DLNQVLNETRSQ

SEQ ID NO: 701 - protein, 12 aa, Artificial
  Consensus peptide
DLNQVLNETRNQ

SEQ ID NO: 702 - protein, 12 aa, Artificial
  Consensus peptide
DLNRVLNETRSQ

SEQ ID NO: 703 - protein, 12 aa, Artificial
  Consensus peptide
DLNRVLNETRNQ

SEQ ID NO: 704 - protein, 12 aa, Artificial
  Consensus peptide
LNQVLNETRSQY

SEQ ID NO: 705 - protein, 12 aa, Artificial
  Consensus peptide
LNQVLNETRNQY

SEQ ID NO: 706 - protein, 12 aa, Artificial
  Consensus peptide
LNRVLNETRSQY

SEQ ID NO: 707 - protein, 12 aa, Artificial
  Consensus peptide
LNRVLNETRNQY

SEQ ID NO: 708 - protein, 12 aa, Artificial
  Consensus peptide
NQVLNETRSQYE

SEQ ID NO: 709 - protein, 12 aa, Artificial
  Consensus peptide
LNQVLNETRNQY

SEQ ID NO: 710 - protein, 12 aa, Artificial
  Consensus peptide
LNRVLNETRSQY

SEQ ID NO: 711 - protein, 12 aa, Artificial
  Consensus peptide
LNRVLNETRNQY

SEQ ID NO: 712 - protein, 12 aa, Artificial
  Consensus peptide
QVLNETRSQYEA

SEQ ID NO: 713 - protein, 12 aa, Artificial
  Consensus peptide
QVLNETRNQYEA

SEQ ID NO: 714 - protein, 12 aa, Artificial
  Consensus peptide
RVLNETRSQYEA

SEQ ID NO: 715 - protein, 12 aa, Artificial
  Consensus peptide
RVLNETRNQYEA

SEQ ID NO: 716 - protein, 12 aa, Artificial
  Consensus peptide
VLNETRSQYEAL

SEQ ID NO: 717 - protein, 12 aa, Artificial
  Consensus peptide
VLNETRNQYEAL

SEQ ID NO: 718 - protein, 13 aa, Artificial
  Consensus peptide
EVNTLRCQLGDRL

SEQ ID NO: 719 - protein, 13 aa, Artificial
  Consensus peptide
EVNTLRCPLGDRL

SEQ ID NO: 720 - protein, 13 aa, Artificial
  Consensus peptide
EVNTLRSQLGDRL

SEQ ID NO: 721 - protein, 13 aa, Artificial
  Consensus peptide
EVNTLRSPLGDRL

SEQ ID NO: 722 - protein, 13 aa, Artificial
  Consensus peptide
VNTLRCQLGDRLN

SEQ ID NO: 723 - protein, 13 aa, Artificial
  Consensus peptide
VNTLRCPLGDRLN

SEQ ID NO: 724 - protein, 13 aa, Artificial
  Consensus peptide
VNTLRSQLGDRLN

SEQ ID NO: 725 - protein, 13 aa, Artificial
  Consensus peptide
VNTLRSPLGDRLN

SEQ ID NO: 726 - protein, 13 aa, Artificial
  Consensus peptide
NTLRCQLGDRLNV

SEQ ID NO: 727 - protein, 13 aa, Artificial
  Consensus peptide
NTLRCPLGDRLNV

SEQ ID NO: 728 - protein, 13 aa, Artificial
  Consensus peptide
NTLRSQLGDRLNV

SEQ ID NO: 729 - protein, 13 aa, Artificial
  Consensus peptide
NTLRSPLGDRLNV

SEQ ID NO: 730 - protein, 13 aa, Artificial
  Consensus peptide
TLRCQLGDRLNVE

SEQ ID NO: 731 - protein, 13 aa, Artificial
  Consensus peptide
TLRCPLGDRLNVE

SEQ ID NO: 732 - protein, 13 aa, Artificial
  Consensus peptide
TLRSQLGDRLNVE

SEQ ID NO: 733 - protein, 13 aa, Artificial
  Consensus peptide
TLRSPLGDRLNVE

SEQ ID NO: 734 - protein, 13 aa, Artificial
  Consensus peptide
LRCQLGDRLNVEV

SEQ ID NO: 735 - protein, 13 aa, Artificial
  Consensus peptide
LRCPLGDRLNVEV

SEQ ID NO: 736 - protein, 13 aa, Artificial
  Consensus peptide
LRSQLGDRLNVEV

SEQ ID NO: 737 - protein, 13 aa, Artificial
  Consensus peptide
LRSPLGDRLNVEV

SEQ ID NO: 738 - protein, 13 aa, Artificial
  Consensus peptide
RCQLGDRLNVEVD

SEQ ID NO: 739 - protein, 13 aa, Artificial
  Consensus peptide
RCPLGDRLNVEVD

SEQ ID NO: 740 - protein, 13 aa, Artificial
  Consensus peptide
RSQLGDRLNVEVD

SEQ ID NO: 741 - protein, 13 aa, Artificial
  Consensus peptide
RSPLGDRLNVEVD

SEQ ID NO: 742 - protein, 13 aa, Artificial
  Consensus peptide
CQLGDRLNVEVDA

SEQ ID NO: 743 - protein, 13 aa, Artificial
  Consensus peptide
CQLGDRLNVEVDT

SEQ ID NO: 744 - protein, 13 aa, Artificial
  Consensus peptide
CPLGDRLNVEVDA

SEQ ID NO: 745 - protein, 13 aa, Artificial
  Consensus peptide
CPLGDRLNVEVDT

SEQ ID NO: 746 - protein, 13 aa, Artificial
  Consensus peptide
SQLGDRLNVEVDA

SEQ ID NO: 747 - protein, 13 aa, Artificial
  Consensus peptide
SQLGDRLNVEVDT

SEQ ID NO: 748 - protein, 13 aa, Artificial
  Consensus peptide
SPLGDRLNVEVDA

SEQ ID NO: 749 - protein, 13 aa, Artificial
  Consensus peptide
SPLGDRLNVEVDT

SEQ ID NO: 750 - protein, 13 aa, Artificial
  Consensus peptide
QLGDRLNVEVDAA

SEQ ID NO: 751 - protein, 13 aa, Artificial
  Consensus peptide
QLGDRLNVEVDTA

SEQ ID NO: 752 - protein, 13 aa, Artificial
  Consensus peptide
PLGDRLNVEVDAA

SEQ ID NO: 753 - protein, 13 aa, Artificial
  Consensus peptide
PLGDRLNVEVDTA

SEQ ID NO: 754 - protein, 13 aa, Artificial
  Consensus peptide
LGDRLNVEVDAAP

SEQ ID NO: 755 - protein, 13 aa, Artificial
  Consensus peptide
LGDRLNVEVDTAP

SEQ ID NO: 756 - protein, 13 aa, Artificial
  Consensus peptide
GDRLNVEVDAAPT

SEQ ID NO: 757 - protein, 13 aa, Artificial
  Consensus peptide
GDRLNVEVDTAPT

SEQ ID NO: 758 - protein, 13 aa, Artificial
  Consensus peptide
DRLNVEVDAAPTV

SEQ ID NO: 759 - protein, 13 aa, Artificial
  Consensus peptide
DRLNVEVDTAPTV

SEQ ID NO: 760 - protein, 13 aa, Artificial
  Consensus peptide
RLNVEVDAAPTVD

SEQ ID NO: 761 - protein, 13 aa, Artificial
  Consensus peptide
RLNVEVDTAPTVD

SEQ ID NO: 762 - protein, 13 aa, Artificial
  Consensus peptide
LNVEVDAAPTVDL

SEQ ID NO: 763 - protein, 13 aa, Artificial
  Consensus peptide
LNVEVDTAPTVDL

SEQ ID NO: 764 - protein, 13 aa, Artificial
  Consensus peptide
NVEVDAAPTVDLN

SEQ ID NO: 765 - protein, 13 aa, Artificial
  Consensus peptide
NVEVDTAPTVDLN

SEQ ID NO: 766 - protein, 13 aa, Artificial
  Consensus peptide
VEVDAAPTVDLNQ

SEQ ID NO: 767 - protein, 13 aa, Artificial
  Consensus peptide
VEVDAAPTVDLNR

SEQ ID NO: 768 - protein, 13 aa, Artificial
  Consensus peptide
VEVDTAPTVDLNQ

SEQ ID NO: 769 - protein, 13 aa, Artificial
  Consensus peptide
VEVDTAPTVDLNR

SEQ ID NO: 770 - protein, 13 aa, Artificial
  Consensus peptide
EVDAAPTVDLNQV

SEQ ID NO: 771 - protein, 13 aa, Artificial
  Consensus peptide
EVDAAPTVDLNRV

SEQ ID NO: 772 - protein, 13 aa, Artificial
  Consensus peptide
EVDTAPTVDLNQV

SEQ ID NO: 773 - protein, 13 aa, Artificial
  Consensus peptide
EVDTAPTVDLNRV

SEQ ID NO: 774 - protein, 13 aa, Artificial
  Consensus peptide
VDAAPTVDLNQVL

SEQ ID NO: 775 - protein, 13 aa, Artificial
  Consensus peptide
VDAAPTVDLNRVL

SEQ ID NO: 776 - protein, 13 aa, Artificial
  Consensus peptide
VDTAPTVDLNQVL

SEQ ID NO: 777 - protein, 13 aa, Artificial
  Consensus peptide
VDTAPTVDLNRVL

SEQ ID NO: 778 - protein, 13 aa, Artificial
  Consensus peptide
DAAPTVDLNQVLN

SEQ ID NO: 779 - protein, 13 aa, Artificial
  Consensus peptide
DAAPTVDLNRVLN

SEQ ID NO: 780 - protein, 13 aa, Artificial
  Consensus peptide
DTAPTVDLNQVLN

SEQ ID NO: 781 - protein, 13 aa, Artificial
  Consensus peptide
DTAPTVDLNRVLN

SEQ ID NO: 782 - protein, 13 aa, Artificial
  Consensus peptide
AAPTVDLNQVLNE

SEQ ID NO: 783 - protein, 13 aa, Artificial
  Consensus peptide
AAPTVDLNRVLNE

SEQ ID NO: 784 - protein, 13 aa, Artificial
  Consensus peptide
TAPTVDLNQVLNE

SEQ ID NO: 785 - protein, 13 aa, Artificial
  Consensus peptide
TAPTVDLNRVLNE

SEQ ID NO: 786 - protein, 13 aa, Artificial
  Consensus peptide
APTVDLNQVLNET

SEQ ID NO: 787 - protein, 13 aa, Artificial
  Consensus peptide
APTVDLNRVLNET

SEQ ID NO: 788 - protein, 13 aa, Artificial
  Consensus peptide
PTVDLNQVLNETR

SEQ ID NO: 789 - protein, 13 aa, Artificial
  Consensus peptide
PTVDLNRVLNETR

SEQ ID NO: 790 - protein, 13 aa, Artificial
  Consensus peptide
TVDLNQVLNETRS

SEQ ID NO: 791 - protein, 13 aa, Artificial
  Consensus peptide
TVDLNQVLNETRN

SEQ ID NO: 792 - protein, 13 aa, Artificial
  Consensus peptide
TVDLNRVLNETRS

SEQ ID NO: 793 - protein, 13 aa, Artificial
  Consensus peptide
TVDLNRVLNETRN

SEQ ID NO: 794 - protein, 13 aa, Artificial
  Consensus peptide
VDLNQVLNETRSQ

SEQ ID NO: 795 - protein, 13 aa, Artificial
  Consensus peptide
VDLNQVLNETRNQ

SEQ ID NO: 796 - protein, 13 aa, Artificial
  Consensus peptide
VDLNRVLNETRSQ

SEQ ID NO: 797 - protein, 13 aa, Artificial
  Consensus peptide
VDLNRVLNETRNQ

SEQ ID NO: 798 - protein, 13 aa, Artificial
  Consensus peptide
DLNQVLNETRSQY

SEQ ID NO: 799 - protein, 13 aa, Artificial
  Consensus peptide
DLNQVLNETRNQY

SEQ ID NO: 800 - protein, 13 aa, Artificial
  Consensus peptide
DLNRVLNETRSQY

SEQ ID NO: 801 - protein, 13 aa, Artificial
  Consensus peptide
DLNRVLNETRNQY

SEQ ID NO: 802 - protein, 13 aa, Artificial
  Consensus peptide
LNQVLNETRSQYE

SEQ ID NO: 803 - protein, 13 aa, Artificial
  Consensus peptide
LNQVLNETRNQYE

SEQ ID NO: 804 - protein, 13 aa, Artificial
  Consensus peptide
LNRVLNETRSQYE

SEQ ID NO: 805 - protein, 13 aa, Artificial
  Consensus peptide
LNRVLNETRNQYE

SEQ ID NO: 806 - protein, 13 aa, Artificial
  Consensus peptide
NQVLNETRSQYEA

SEQ ID NO: 807 - protein, 13 aa, Artificial
  Consensus peptide
NQVLNETRNQYEA

SEQ ID NO: 808 - protein, 13 aa, Artificial
  Consensus peptide
NRVLNETRSQYEA

SEQ ID NO: 809 - protein, 13 aa, Artificial
  Consensus peptide
NRVLNETRNQYEA

SEQ ID NO: 810 - protein, 13 aa, Artificial
  Consensus peptide
QVLNETRSQYEAL

SEQ ID NO: 811 - protein, 13 aa, Artificial
  Consensus peptide
QVLNETRNQYEAL

SEQ ID NO: 812 - protein, 13 aa, Artificial
  Consensus peptide
RVLNETRSQYEAL

SEQ ID NO: 813 - protein, 13 aa, Artificial
  Consensus peptide
RVLNETRNQYEAL

SEQ ID NO: 814 - protein, 14 aa, Artificial
  Consensus peptide
EVNTLRCQLGDRLN

SEQ ID NO: 815 - protein, 14 aa, Artificial
  Consensus peptide
EVNTLRCPLGDRLN

SEQ ID NO: 816 - protein, 14 aa, Artificial
  Consensus peptide
EVNTLRSQLGDRLN

SEQ ID NO: 817 - protein, 14 aa, Artificial
  Consensus peptide
EVNTLRSPLGDRLN

SEQ ID NO: 818 - protein, 14 aa, Artificial
  Consensus peptide
VNTLRCQLGDRLNV

SEQ ID NO: 819 - protein, 14 aa, Artificial
  Consensus peptide
VNTLRCPLGDRLNV

SEQ ID NO: 820 - protein, 14 aa, Artificial
  Consensus peptide
VNTLRSQLGDRLNV

SEQ ID NO: 821 - protein, 14 aa, Artificial
  Consensus peptide
VNTLRSPLGDRLNV

SEQ ID NO: 822 - protein, 14 aa, Artificial
  Consensus peptide
NTLRCQLGDRLNVE

SEQ ID NO: 823 - protein, 14 aa, Artificial
  Consensus peptide
NTLRCPLGDRLNVE

SEQ ID NO: 824 - protein, 14 aa, Artificial
  Consensus peptide
NTLRSQLGDRLNVE

SEQ ID NO: 825 - protein, 14 aa, Artificial
  Consensus peptide
NTLRSPLGDRLNVE

SEQ ID NO: 826 - protein, 14 aa, Artificial
  Consensus peptide
TLRCQLGDRLNVEV

SEQ ID NO: 827 - protein, 14 aa, Artificial
  Consensus peptide
TLRCPLGDRLNVEV

SEQ ID NO: 828 - protein, 14 aa, Artificial
  Consensus peptide
TLRSQLGDRLNVEV

SEQ ID NO: 829 - protein, 14 aa, Artificial
  Consensus peptide
TLRSPLGDRLNVEV

SEQ ID NO: 830 - protein, 14 aa, Artificial
  Consensus peptide
LRCQLGDRLNVEVD

SEQ ID NO: 831 - protein, 14 aa, Artificial
  Consensus peptide
LRCPLGDRLNVEVD

SEQ ID NO: 832 - protein, 14 aa, Artificial
  Consensus peptide
LRSQLGDRLNVEVD

SEQ ID NO: 833 - protein, 14 aa, Artificial
  Consensus peptide
LRSPLGDRLNVEVD

SEQ ID NO: 834 - protein, 14 aa, Artificial
  Consensus peptide
RCQLGDRLNVEVDA

SEQ ID NO: 835 - protein, 14 aa, Artificial
  Consensus peptide
RCQLGDRLNVEVDT

SEQ ID NO: 836 - protein, 14 aa, Artificial
  Consensus peptide
RCPLGDRLNVEVDA

SEQ ID NO: 837 - protein, 14 aa, Artificial
  Consensus peptide
RCPLGDRLNVEVDT

SEQ ID NO: 838 - protein, 14 aa, Artificial
  Consensus peptide
RSQLGDRLNVEVDA

SEQ ID NO: 839 - protein, 14 aa, Artificial
  Consensus peptide
RSQLGDRLNVEVDT

SEQ ID NO: 840 - protein, 14 aa, Artificial
  Consensus peptide
RSPLGDRLNVEVDA

SEQ ID NO: 841 - protein, 14 aa, Artificial
  Consensus peptide
RSPLGDRLNVEVDT

SEQ ID NO: 842 - protein, 14 aa, Artificial
  Consensus peptide
CQLGDRLNVEVDAA

SEQ ID NO: 843 - protein, 14 aa, Artificial
  Consensus peptide
CQLGDRLNVEVDTA

SEQ ID NO: 844 - protein, 14 aa, Artificial
  Consensus peptide
CPLGDRLNVEVDAA

SEQ ID NO: 845 - protein, 14 aa, Artificial
  Consensus peptide
CPLGDRLNVEVDTA

SEQ ID NO: 846 - protein, 14 aa, Artificial
  Consensus peptide
SQLGDRLNVEVDAA

SEQ ID NO: 847 - protein, 14 aa, Artificial
  Consensus peptide
SQLGDRLNVEVDTA

SEQ ID NO: 848 - protein, 14 aa, Artificial
  Consensus peptide
SPLGDRLNVEVDAA

SEQ ID NO: 849 - protein, 14 aa, Artificial
  Consensus peptide
SPLGDRLNVEVDTA

SEQ ID NO: 850 - protein, 14 aa, Artificial
  Consensus peptide
QLGDRLNVEVDAAP

SEQ ID NO: 851 - protein, 14 aa, Artificial
  Consensus peptide
QLGDRLNVEVDTAP

SEQ ID NO: 852 - protein, 14 aa, Artificial
  Consensus peptide
PLGDRLNVEVDAAP

SEQ ID NO: 853 - protein, 14 aa, Artificial
  Consensus peptide
PLGDRLNVEVDTAP

SEQ ID NO: 854 - protein, 14 aa, Artificial
  Consensus peptide
LGDRLNVEVDAAPT

SEQ ID NO: 855 - protein, 14 aa, Artificial
  Consensus peptide
LGDRLNVEVDTAPT

SEQ ID NO: 856 - protein, 14 aa, Artificial
  Consensus peptide
GDRLNVEVDAAPTV

SEQ ID NO: 857 - protein, 14 aa, Artificial
  Consensus peptide
GDRLNVEVDTAPTV

SEQ ID NO: 858 - protein, 14 aa, Artificial
  Consensus peptide
DRLNVEVDAAPTVD

SEQ ID NO: 859 - protein, 14 aa, Artificial
  Consensus peptide
DRLNVEVDTAPTVD

SEQ ID NO: 860 - protein, 14 aa, Artificial
  Consensus peptide
RLNVEVDAAPTVDL

SEQ ID NO: 861 - protein, 14 aa, Artificial
  Consensus peptide
RLNVEVDTAPTVDL

SEQ ID NO: 862 - protein, 14 aa, Artificial
  Consensus peptide
LNVEVDAAPTVDLN

SEQ ID NO: 863 - protein, 14 aa, Artificial
  Consensus peptide
LNVEVDTAPTVDLN

SEQ ID NO: 864 - protein, 14 aa, Artificial
  Consensus peptide
NVEVDAAPTVDLNQ

SEQ ID NO: 865 - protein, 14 aa, Artificial
  Consensus peptide
NVEVDAAPTVDLNR

SEQ ID NO: 866 - protein, 14 aa, Artificial
  Consensus peptide
NVEVDTAPTVDLNQ

SEQ ID NO: 867 - protein, 14 aa, Artificial
  Consensus peptide
NVEVDTAPTVDLNR

SEQ ID NO: 868 - protein, 14 aa, Artificial
  Consensus peptide
VEVDAAPTVDLNQV

SEQ ID NO: 869 - protein, 14 aa, Artificial
  Consensus peptide
VEVDAAPTVDLNRV

SEQ ID NO: 870 - protein, 14 aa, Artificial
  Consensus peptide
VEVDTAPTVDLNQV

SEQ ID NO: 871 - protein, 14 aa, Artificial
  Consensus peptide
VEVDTAPTVDLNRV

SEQ ID NO: 872 - protein, 14 aa, Artificial
  Consensus peptide
EVDAAPTVDLNQVL

SEQ ID NO: 873 - protein, 14 aa, Artificial
  Consensus peptide
EVDAAPTVDLNRVL

SEQ ID NO: 874 - protein, 14 aa, Artificial
  Consensus peptide
EVDTAPTVDLNQVL

SEQ ID NO: 875 - protein, 14 aa, Artificial
  Consensus peptide
EVDTAPTVDLNRVL

SEQ ID NO: 876 - protein, 14 aa, Artificial
  Consensus peptide
VDAAPTVDLNQVLN

SEQ ID NO: 877 - protein, 14 aa, Artificial
  Consensus peptide
VDAAPTVDLNRVLN

SEQ ID NO: 878 - protein, 14 aa, Artificial
  Consensus peptide
VDTAPTVDLNQVLN

SEQ ID NO: 879 - protein, 14 aa, Artificial
  Consensus peptide
VDTAPTVDLNRVLN

SEQ ID NO: 880 - protein, 14 aa, Artificial
  Consensus peptide
DAAPTVDLNQVLNE

SEQ ID NO: 881 - protein, 14 aa, Artificial
  Consensus peptide
DAAPTVDLNRVLNE

SEQ ID NO: 882 - protein, 14 aa, Artificial
  Consensus peptide
DTAPTVDLNQVLNE

SEQ ID NO: 883 - protein, 14 aa, Artificial
  Consensus peptide
DTAPTVDLNRVLNE

SEQ ID NO: 884 - protein, 14 aa, Artificial
  Consensus peptide
AAPTVDLNQVLNET

SEQ ID NO: 885 - protein, 14 aa, Artificial
  Consensus peptide
AAPTVDLNRVLNET

SEQ ID NO: 886 - protein, 14 aa, Artificial
  Consensus peptide
TAPTVDLNQVLNET

SEQ ID NO: 887 - protein, 14 aa, Artificial
  Consensus peptide
TAPTVDLNRVLNET

SEQ ID NO: 888 - protein, 14 aa, Artificial
  Consensus peptide
APTVDLNQVLNETR

SEQ ID NO: 889 - protein, 14 aa, Artificial
  Consensus peptide
APTVDLNRVLNETR

SEQ ID NO: 890 - protein, 14 aa, Artificial
  Consensus peptide
PTVDLNQVLNETRS

SEQ ID NO: 891 - protein, 14 aa, Artificial
  Consensus peptide
PTVDLNQVLNETRN

SEQ ID NO: 892 - protein, 14 aa, Artificial
  Consensus peptide
PTVDLNRVLNETRS

SEQ ID NO: 893 - protein, 14 aa, Artificial
  Consensus peptide
PTVDLNRVLNETRN

SEQ ID NO: 894 - protein, 14 aa, Artificial
  Consensus peptide
TVDLNQVLNETRSQ

SEQ ID NO: 895 - protein, 14 aa, Artificial
  Consensus peptide
TVDLNQVLNETRNQ

SEQ ID NO: 896 - protein, 14 aa, Artificial
  Consensus peptide
TVDLNRVLNETRSQ

SEQ ID NO: 897 - protein, 14 aa, Artificial
  Consensus peptide
TVDLNRVLNETRNQ

SEQ ID NO: 898 - protein, 14 aa, Artificial
  Consensus peptide
VDLNQVLNETRSQY

SEQ ID NO: 899 - protein, 14 aa, Artificial
  Consensus peptide
VDLNQVLNETRNQY

SEQ ID NO: 900 - protein, 14 aa, Artificial
  Consensus peptide
VDLNRVLNETRSQY

SEQ ID NO: 901 - protein, 14 aa, Artificial
  Consensus peptide
VDLNRVLNETRNQY

SEQ ID NO: 902 - protein, 14 aa, Artificial
  Consensus peptide
DLNQVLNETRSQYE

SEQ ID NO: 903 - protein, 14 aa, Artificial
  Consensus peptide
DLNQVLNETRNQYE

SEQ ID NO: 904 - protein, 14 aa, Artificial
  Consensus peptide
DLNRVLNETRSQYE

SEQ ID NO: 905 - protein, 14 aa, Artificial
  Consensus peptide
DLNRVLNETRNQYE

SEQ ID NO: 906 - protein, 14 aa, Artificial
  Consensus peptide
LNQVLNETRSQYEA

SEQ ID NO: 907 - protein, 14 aa, Artificial
  Consensus peptide
LNQVLNETRNQYEA

SEQ ID NO: 908 - protein, 14 aa, Artificial
  Consensus peptide
LNRVLNETRSQYEA

SEQ ID NO: 909 - protein, 14 aa, Artificial
  Consensus peptide
LNRVLNETRNQYEA

SEQ ID NO: 910 - protein, 14 aa, Artificial
  Consensus peptide
NQVLNETRSQYEAL

SEQ ID NO: 911 - protein, 14 aa, Artificial
  Consensus peptide
NQVLNETRNQYEAL

SEQ ID NO: 912 - protein, 14 aa, Artificial
  Consensus peptide
NRVLNETRSQYEAL

SEQ ID NO: 913 - protein, 14 aa, Artificial
  Consensus peptide
NRVLNETRNQYEAL

SEQ ID NO: 914 - protein, 15 aa, Artificial
  Consensus peptide
EVNTLRCQLGDRLNV

SEQ ID NO: 915 - protein, 15 aa, Artificial
  Consensus peptide
EVNTLRCPLGDRLNV

SEQ ID NO: 916 - protein, 15 aa, Artificial
  Consensus peptide
EVNTLRSQLGDRLNV

SEQ ID NO: 917 - protein, 15 aa, Artificial
  Consensus peptide
EVNTLRSPLGDRLNV

SEQ ID NO: 918 - protein, 15 aa, Artificial
  Consensus peptide
VNTLRCQLGDRLNVE

SEQ ID NO: 919 - protein, 15 aa, Artificial
  Consensus peptide
VNTLRCPLGDRLNVE

SEQ ID NO: 920 - protein, 15 aa, Artificial
  Consensus peptide
VNTLRSQLGDRLNVE

SEQ ID NO: 921 - protein, 15 aa, Artificial
  Consensus peptide
VNTLRSPLGDRLNVE

SEQ ID NO: 922 - protein, 15 aa, Artificial
  Consensus peptide
NTLRCQLGDRLNVEV

SEQ ID NO: 923 - protein, 15 aa, Artificial
  Consensus peptide
NTLRCPLGDRLNVEV

SEQ ID NO: 924 - protein, 15 aa, Artificial
  Consensus peptide
NTLRSQLGDRLNVEV

SEQ ID NO: 925 - protein, 15 aa, Artificial
  Consensus peptide
NTLRSPLGDRLNVEV

SEQ ID NO: 926 - protein, 15 aa, Artificial
  Consensus peptide
TLRCQLGDRLNVEVD

SEQ ID NO: 927 - protein, 15 aa, Artificial
  Consensus peptide
TLRCPLGDRLNVEVD

SEQ ID NO: 928 - protein, 15 aa, Artificial
  Consensus peptide
TLRSQLGDRLNVEVD

SEQ ID NO: 929 - protein, 15 aa, Artificial
  Consensus peptide
TLRSPLGDRLNVEVD

SEQ ID NO: 930 - protein, 15 aa, Artificial
  Consensus peptide
LRCQLGDRLNVEVDA

SEQ ID NO: 931 - protein, 15 aa, Artificial
  Consensus peptide
LRCQLGDRLNVEVDT

SEQ ID NO: 932 - protein, 15 aa, Artificial
  Consensus peptide
LRCPLGDRLNVEVDA

SEQ ID NO: 933 - protein, 15 aa, Artificial
  Consensus peptide
LRCPLGDRLNVEVDT

SEQ ID NO: 934 - protein, 15 aa, Artificial
  Consensus peptide
LRSQLGDRLNVEVDA

SEQ ID NO: 935 - protein, 15 aa, Artificial
  Consensus peptide
LRSQLGDRLNVEVDT

SEQ ID NO: 936 - protein, 15 aa, Artificial
  Consensus peptide
LRSPLGDRLNVEVDA

SEQ ID NO: 937 - protein, 15 aa, Artificial
  Consensus peptide
LRSPLGDRLNVEVDT

SEQ ID NO: 938 - protein, 15 aa, Artificial
  Consensus peptide
RCQLGDRLNVEVDAA

SEQ ID NO: 939 - protein, 15 aa, Artificial
  Consensus peptide
RCQLGDRLNVEVDTA

SEQ ID NO: 940 - protein, 15 aa, Artificial
  Consensus peptide
RCPLGDRLNVEVDAA

SEQ ID NO: 941 - protein, 15 aa, Artificial
  Consensus peptide
RCPLGDRLNVEVDTA

SEQ ID NO: 942 - protein, 15 aa, Artificial
  Consensus peptide
RSQLGDRLNVEVDAA

SEQ ID NO: 943 - protein, 15 aa, Artificial
  Consensus peptide
RSQLGDRLNVEVDTA

SEQ ID NO: 944 - protein, 15 aa, Artificial
  Consensus peptide
RSPLGDRLNVEVDAA

SEQ ID NO: 945 - protein, 15 aa, Artificial
  Consensus peptide
RSPLGDRLNVEVDTA

SEQ ID NO: 946 - protein, 15 aa, Artificial
  Consensus peptide
CQLGDRLNVEVDAAP

SEQ ID NO: 947 - protein, 15 aa, Artificial
  Consensus peptide
CQLGDRLNVEVDTAP

SEQ ID NO: 948 - protein, 15 aa, Artificial
  Consensus peptide
CPLGDRLNVEVDAAP

SEQ ID NO: 949 - protein, 15 aa, Artificial
  Consensus peptide
CPLGDRLNVEVDTAP

SEQ ID NO: 950 - protein, 15 aa, Artificial
  Consensus peptide
SQLGDRLNVEVDAAP

SEQ ID NO: 951 - protein, 15 aa, Artificial
  Consensus peptide
SQLGDRLNVEVDTAP

SEQ ID NO: 952 - protein, 15 aa, Artificial
  Consensus peptide
SPLGDRLNVEVDAAP

SEQ ID NO: 953 - protein, 15 aa, Artificial
  Consensus peptide
SPLGDRLNVEVDTAP

SEQ ID NO: 954 - protein, 15 aa, Artificial
  Consensus peptide
QLGDRLNVEVDAAPT

SEQ ID NO: 955 - protein, 15 aa, Artificial
  Consensus peptide
QLGDRLNVEVDTAPT

SEQ ID NO: 956 - protein, 15 aa, Artificial
  Consensus peptide
PLGDRLNVEVDAAPT

SEQ ID NO: 957 - protein, 15 aa, Artificial
  Consensus peptide
PLGDRLNVEVDTAPT

SEQ ID NO: 958 - protein, 15 aa, Artificial
  Consensus peptide
LGDRLNVEVDAAPTV

SEQ ID NO: 959 - protein, 15 aa, Artificial
  Consensus peptide
LGDRLNVEVDTAPTV

SEQ ID NO: 960 - protein, 15 aa, Artificial
  Consensus peptide
GDRLNVEVDAAPTVD

SEQ ID NO: 961 - protein, 15 aa, Artificial
  Consensus peptide
GDRLNVEVDTAPTVD

SEQ ID NO: 962 - protein, 15 aa, Artificial
  Consensus peptide
DRLNVEVDAAPTVDL

SEQ ID NO: 963 - protein, 15 aa, Artificial
  Consensus peptide
DRLNVEVDTAPTVDL

SEQ ID NO: 964 - protein, 15 aa, Artificial
  Consensus peptide
RLNVEVDAAPTVDLN

SEQ ID NO: 965 - protein, 15 aa, Artificial
  Consensus peptide
RLNVEVDTAPTVDLN

SEQ ID NO: 966 - protein, 15 aa, Artificial
  Consensus peptide
LNVEVDAAPTVDLNQ

SEQ ID NO: 967 - protein, 15 aa, Artificial
  Consensus peptide
LNVEVDAAPTVDLNR

SEQ ID NO: 968 - protein, 15 aa, Artificial
  Consensus peptide
LNVEVDTAPTVDLNQ

SEQ ID NO: 969 - protein, 15 aa, Artificial
  Consensus peptide
LNVEVDTAPTVDLNR

SEQ ID NO: 970 - protein, 15 aa, Artificial
  Consensus peptide
NVEVDAAPTVDLNQV

SEQ ID NO: 971 - protein, 15 aa, Artificial
  Consensus peptide
NVEVDAAPTVDLNRV

SEQ ID NO: 972 - protein, 15 aa, Artificial
  Consensus peptide
NVEVDTAPTVDLNQV

SEQ ID NO: 973 - protein, 15 aa, Artificial
  Consensus peptide
NVEVDTAPTVDLNRV

SEQ ID NO: 974 - protein, 15 aa, Artificial
  Consensus peptide
VEVDAAPTVDLNQVL

SEQ ID NO: 975 - protein, 15 aa, Artificial
  Consensus peptide
VEVDAAPTVDLNRVL

SEQ ID NO: 976 - protein, 15 aa, Artificial
  Consensus peptide
VEVDTAPTVDLNQVL

SEQ ID NO: 977 - protein, 15 aa, Artificial
  Consensus peptide
VEVDTAPTVDLNRVL

SEQ ID NO: 978 - protein, 15 aa, Artificial
  Consensus peptide
EVDAAPTVDLNQVLN

SEQ ID NO: 979 - protein, 15 aa, Artificial
  Consensus peptide
EVDAAPTVDLNRVLN

SEQ ID NO: 980 - protein, 15 aa, Artificial
  Consensus peptide
EVDTAPTVDLNQVLN

SEQ ID NO: 981 - protein, 15 aa, Artificial
  Consensus peptide
EVDTAPTVDLNRVLN

SEQ ID NO: 982 - protein, 15 aa, Artificial
  Consensus peptide
VDAAPTVDLNQVLNE

SEQ ID NO: 983 - protein, 15 aa, Artificial
  Consensus peptide
VDAAPTVDLNRVLNE

SEQ ID NO: 984 - protein, 15 aa, Artificial
  Consensus peptide
VDTAPTVDLNQVLNE

SEQ ID NO: 985 - protein, 15 aa, Artificial
  Consensus peptide
VDTAPTVDLNRVLNE

SEQ ID NO: 986 - protein, 15 aa, Artificial
  Consensus peptide
DAAPTVDLNQVLNET

SEQ ID NO: 987 - protein, 15 aa, Artificial
  Consensus peptide
DAAPTVDLNRVLNET

SEQ ID NO: 988 - protein, 15 aa, Artificial
  Consensus peptide
DTAPTVDLNQVLNET

SEQ ID NO: 989 - protein, 15 aa, Artificial
  Consensus peptide
DTAPTVDLNRVLNET

SEQ ID NO: 990 - protein, 15 aa, Artificial
  Consensus peptide
AAPTVDLNQVLNETR

SEQ ID NO: 991 - protein, 15 aa, Artificial
  Consensus peptide
AAPTVDLNRVLNETR

SEQ ID NO: 992 - protein, 15 aa, Artificial
  Consensus peptide
TAPTVDLNQVLNETR

SEQ ID NO: 993 - protein, 15 aa, Artificial
  Consensus peptide
TAPTVDLNRVLNETR

SEQ ID NO: 994 - protein, 15 aa, Artificial
  Consensus peptide
APTVDLNQVLNETRS

SEQ ID NO: 995 - protein, 15 aa, Artificial
  Consensus peptide
APTVDLNQVLNETRN

SEQ ID NO: 996 - protein, 15 aa, Artificial
  Consensus peptide
APTVDLNRVLNETRS

SEQ ID NO: 997 - protein, 15 aa, Artificial
  Consensus peptide
APTVDLNRVLNETRN

SEQ ID NO: 998 - protein, 15 aa, Artificial
  Consensus peptide
PTVDLNQVLNETRSQ

SEQ ID NO: 999 - protein, 15 aa, Artificial
  Consensus peptide
PTVDLNQVLNETRNQ

SEQ ID NO: 1000 - protein, 15 aa, Artificial
  Consensus peptide
PTVDLNRVLNETRSQ

SEQ ID NO: 1001 - protein, 15 aa, Artificial
  Consensus peptide
PTVDLNRVLNETRNQ

SEQ ID NO: 1002 - protein, 15 aa, Artificial
  Consensus peptide
TVDLNQVLNETRSQY

SEQ ID NO: 1003 - protein, 15 aa, Artificial
  Consensus peptide
TVDLNQVLNETRNQY

SEQ ID NO: 1004 - protein, 15 aa, Artificial
  Consensus peptide
TVDLNRVLNETRSQY

SEQ ID NO: 1005 - protein, 15 aa, Artificial
  Consensus peptide
TVDLNRVLNETRNQY

SEQ ID NO: 1006 - protein, 15 aa, Artificial
  Consensus peptide
VDLNQVLNETRSQYE

SEQ ID NO: 1007 - protein, 15 aa, Artificial
  Consensus peptide
VDLNQVLNETRNQYE

SEQ ID NO: 1008 - protein, 15 aa, Artificial
  Consensus peptide
VDLNRVLNETRSQYE

SEQ ID NO: 1009 - protein, 15 aa, Artificial
  Consensus peptide
VDLNRVLNETRNQYE

SEQ ID NO: 1010 - protein, 15 aa, Artificial
  Consensus peptide
DLNQVLNETRSQYEA

SEQ ID NO: 1011 - protein, 15 aa, Artificial
  Consensus peptide
DLNQVLNETRNQYEA

SEQ ID NO: 1012 - protein, 15 aa, Artificial
  Consensus peptide
DLNRVLNETRSQYEA

SEQ ID NO: 1013 - protein, 15 aa, Artificial
  Consensus peptide
DLNRVLNETRNQYEA

SEQ ID NO: 1014 - protein, 15 aa, Artificial
  Consensus peptide
LNQVLNETRSQYEAL

SEQ ID NO: 1015 - protein, 15 aa, Artificial
  Consensus peptide
LNQVLNETRNQYEAL

SEQ ID NO: 1016 - protein, 15 aa, Artificial
  Consensus peptide
LNRVLNETRSQYEAL

SEQ ID NO: 1017 - protein, 15 aa, Artificial
  Consensus peptide
LNRVLNETRNQYEAL

SEQ ID NO: 1018 - protein, 16 aa, Artificial
  Consensus peptide
EVNTLRCQLGDRLNVE

SEQ ID NO: 1019 - protein, 16 aa, Artificial
  Consensus peptide
EVNTLRCPLGDRLNVE

SEQ ID NO: 1020 - protein, 16 aa, Artificial
  Consensus peptide
EVNTLRSQLGDRLNVE

SEQ ID NO: 1021 - protein, 16 aa, Artificial
  Consensus peptide
EVNTLRSPLGDRLNVE

SEQ ID NO: 1022 - protein, 16 aa, Artificial
  Consensus peptide
VNTLRCQLGDRLNVEV

SEQ ID NO: 1023 - protein, 16 aa, Artificial
  Consensus peptide
VNTLRCPLGDRLNVEV

SEQ ID NO: 1024 - protein, 16 aa, Artificial
  Consensus peptide
VNTLRSQLGDRLNVEV

SEQ ID NO: 1025 - protein, 16 aa, Artificial
  Consensus peptide
VNTLRSPLGDRLNVEV

SEQ ID NO: 1026 - protein, 16 aa, Artificial
  Consensus peptide
NTLRCQLGDRLNVEVD

SEQ ID NO: 1027 - protein, 16 aa, Artificial
  Consensus peptide
NTLRCPLGDRLNVEVD

SEQ ID NO: 1028 - protein, 16 aa, Artificial
  Consensus peptide
NTLRSQLGDRLNVEVD

SEQ ID NO: 1029 - protein, 16 aa, Artificial
  Consensus peptide
NTLRSPLGDRLNVEVD

SEQ ID NO: 1030 - protein, 16 aa, Artificial
  Consensus peptide
TLRCQLGDRLNVEVDA

SEQ ID NO: 1031 - protein, 16 aa, Artificial
  Consensus peptide
TLRCQLGDRLNVEVDT

SEQ ID NO: 1032 - protein, 16 aa, Artificial
  Consensus peptide
TLRCPLGDRLNVEVDA

SEQ ID NO: 1033 - protein, 16 aa, Artificial
  Consensus peptide
TLRCPLGDRLNVEVDT

SEQ ID NO: 1034 - protein, 16 aa, Artificial
  Consensus peptide
TLRSQLGDRLNVEVDA

SEQ ID NO: 1035 - protein, 16 aa, Artificial
  Consensus peptide
TLRSQLGDRLNVEVDT

SEQ ID NO: 1036 - protein, 16 aa, Artificial
  Consensus peptide
TLRSPLGDRLNVEVDA

SEQ ID NO: 1037 - protein, 16 aa, Artificial
  Consensus peptide
TLRSPLGDRLNVEVDT

SEQ ID NO: 1038 - protein, 16 aa, Artificial
  Consensus peptide
LRCQLGDRLNVEVDAA

SEQ ID NO: 1039 - protein, 16 aa, Artificial
  Consensus peptide
LRCQLGDRLNVEVDTA

SEQ ID NO: 1040 - protein, 16 aa, Artificial
  Consensus peptide
LRCPLGDRLNVEVDAA

SEQ ID NO: 1041 - protein, 16 aa, Artificial
  Consensus peptide
LRCPLGDRLNVEVDTA

SEQ ID NO: 1042 - protein, 16 aa, Artificial
  Consensus peptide
LRSQLGDRLNVEVDAA

SEQ ID NO: 1043 - protein, 16 aa, Artificial
  Consensus peptide
LRSQLGDRLNVEVDTA

SEQ ID NO: 1044 - protein, 16 aa, Artificial
  Consensus peptide
LRSPLGDRLNVEVDAA

SEQ ID NO: 1045 - protein, 16 aa, Artificial
  Consensus peptide
LRSPLGDRLNVEVDTA

SEQ ID NO: 1046 - protein, 16 aa, Artificial
  Consensus peptide
RCQLGDRLNVEVDAAP

SEQ ID NO: 1047 - protein, 16 aa, Artificial
  Consensus peptide
RCQLGDRLNVEVDTAP

SEQ ID NO: 1048 - protein, 16 aa, Artificial
  Consensus peptide
RCPLGDRLNVEVDAAP

SEQ ID NO: 1049 - protein, 16 aa, Artificial
  Consensus peptide
RCPLGDRLNVEVDTAP

SEQ ID NO: 1050 - protein, 16 aa, Artificial
  Consensus peptide
RSQLGDRLNVEVDAAP

SEQ ID NO: 1051 - protein, 16 aa, Artificial
  Consensus peptide
RSQLGDRLNVEVDTAP

SEQ ID NO: 1052 - protein, 16 aa, Artificial
  Consensus peptide
RSPLGDRLNVEVDAAP

SEQ ID NO: 1053 - protein, 16 aa, Artificial
  Consensus peptide
RSPLGDRLNVEVDTAP

SEQ ID NO: 1054 - protein, 16 aa, Artificial
  Consensus peptide
CQLGDRLNVEVDAAPT

SEQ ID NO: 1055 - protein, 16 aa, Artificial
  Consensus peptide
CQLGDRLNVEVDTAPT

SEQ ID NO: 1056 - protein, 16 aa, Artificial
  Consensus peptide
CPLGDRLNVEVDAAPT

SEQ ID NO: 1057 - protein, 16 aa, Artificial
  Consensus peptide
CPLGDRLNVEVDTAPT

SEQ ID NO: 1058 - protein, 16 aa, Artificial
  Consensus peptide
SQLGDRLNVEVDAAPT

SEQ ID NO: 1059 - protein, 16 aa, Artificial
  Consensus peptide
SQLGDRLNVEVDTAPT

SEQ ID NO: 1060 - protein, 16 aa, Artificial
  Consensus peptide
SPLGDRLNVEVDAAPT

SEQ ID NO: 1061 - protein, 16 aa, Artificial
  Consensus peptide
SPLGDRLNVEVDTAPT

SEQ ID NO: 1062 - protein, 16 aa, Artificial
  Consensus peptide
QLGDRLNVEVDAAPTV

SEQ ID NO: 1063 - protein, 16 aa, Artificial
  Consensus peptide
QLGDRLNVEVDTAPTV

SEQ ID NO: 1064 - protein, 16 aa, Artificial
  Consensus peptide
PLGDRLNVEVDAAPTV

SEQ ID NO: 1065 - protein, 16 aa, Artificial
  Consensus peptide
PLGDRLNVEVDTAPTV

SEQ ID NO: 1066 - protein, 16 aa, Artificial
  Consensus peptide
LGDRLNVEVDAAPTVD

SEQ ID NO: 1067 - protein, 16 aa, Artificial
  Consensus peptide
LGDRLNVEVDTAPTVD

SEQ ID NO: 1068 - protein, 16 aa, Artificial
  Consensus peptide
GDRLNVEVDAAPTVDL

SEQ ID NO: 1069 - protein, 16 aa, Artificial
  Consensus peptide
GDRLNVEVDTAPTVDL

SEQ ID NO: 1070 - protein, 16 aa, Artificial
  Consensus peptide
DRLNVEVDAAPTVDLN

SEQ ID NO: 1071 - protein, 16 aa, Artificial
  Consensus peptide
DRLNVEVDTAPTVDLN

SEQ ID NO: 1072 - protein, 16 aa, Artificial
  Consensus peptide
RLNVEVDAAPTVDLNQ

SEQ ID NO: 1073 - protein, 16 aa, Artificial
  Consensus peptide
RLNVEVDAAPTVDLNR

SEQ ID NO: 1074 - protein, 16 aa, Artificial
  Consensus peptide
RLNVEVDTAPTVDLNQ

SEQ ID NO: 1075 - protein, 16 aa, Artificial
  Consensus peptide
RLNVEVDTAPTVDLNR

SEQ ID NO: 1076 - protein, 16 aa, Artificial
  Consensus peptide
LNVEVDAAPTVDLNQV

SEQ ID NO: 1077 - protein, 16 aa, Artificial
  Consensus peptide
LNVEVDAAPTVDLNRV

SEQ ID NO: 1078 - protein, 16 aa, Artificial
  Consensus peptide
LNVEVDTAPTVDLNQV

SEQ ID NO: 1079 - protein, 16 aa, Artificial
  Consensus peptide
LNVEVDTAPTVDLNRV

SEQ ID NO: 1080 - protein, 16 aa, Artificial
  Consensus peptide
NVEVDAAPTVDLNQVL

SEQ ID NO: 1081 - protein, 16 aa, Artificial
  Consensus peptide
NVEVDAAPTVDLNRVL

SEQ ID NO: 1082 - protein, 16 aa, Artificial
  Consensus peptide
NVEVDTAPTVDLNQVL

SEQ ID NO: 1083 - protein, 16 aa, Artificial
  Consensus peptide
NVEVDTAPTVDLNRVL

SEQ ID NO: 1084 - protein, 16 aa, Artificial
  Consensus peptide
VEVDAAPTVDLNQVLN

SEQ ID NO: 1085 - protein, 16 aa, Artificial
  Consensus peptide
VEVDAAPTVDLNRVLN

SEQ ID NO: 1086 - protein, 16 aa, Artificial
  Consensus peptide
VEVDTAPTVDLNQVLN

SEQ ID NO: 1087 - protein, 16 aa, Artificial
  Consensus peptide
VEVDTAPTVDLNRVLN

SEQ ID NO: 1088 - protein, 16 aa, Artificial
  Consensus peptide
EVDAAPTVDLNQVLNE

SEQ ID NO: 1089 - protein, 16 aa, Artificial
  Consensus peptide
EVDAAPTVDLNRVLNE

SEQ ID NO: 1090 - protein, 16 aa, Artificial
  Consensus peptide
EVDTAPTVDLNQVLNE

SEQ ID NO: 1091 - protein, 16 aa, Artificial
  Consensus peptide
EVDTAPTVDLNRVLNE

SEQ ID NO: 1092 - protein, 16 aa, Artificial
  Consensus peptide
VDAAPTVDLNQVLNET

SEQ ID NO: 1093 - protein, 16 aa, Artificial
  Consensus peptide
VDAAPTVDLNRVLNET

SEQ ID NO: 1094 - protein, 16 aa, Artificial
  Consensus peptide
VDTAPTVDLNQVLNET

SEQ ID NO: 1095 - protein, 16 aa, Artificial
  Consensus peptide
VDTAPTVDLNRVLNET

SEQ ID NO: 1096 - protein, 16 aa, Artificial
  Consensus peptide
DAAPTVDLNQVLNETR

SEQ ID NO: 1097 - protein, 16 aa, Artificial
  Consensus peptide
DAAPTVDLNRVLNETR

SEQ ID NO: 1098 - protein, 16 aa, Artificial
  Consensus peptide
DTAPTVDLNQVLNETR

SEQ ID NO: 1099 - protein, 16 aa, Artificial
  Consensus peptide
DTAPTVDLNRVLNETR

SEQ ID NO: 1100 - protein, 16 aa, Artificial
  Consensus peptide
AAPTVDLNQVLNETRS

SEQ ID NO: 1101 - protein, 16 aa, Artificial
  Consensus peptide
AAPTVDLNQVLNETRN

SEQ ID NO: 1102 - protein, 16 aa, Artificial
  Consensus peptide
AAPTVDLNRVLNETRS

SEQ ID NO: 1103 - protein, 16 aa, Artificial
  Consensus peptide
AAPTVDLNRVLNETRN

SEQ ID NO: 1104 - protein, 16 aa, Artificial
  Consensus peptide
TAPTVDLNQVLNETRS

SEQ ID NO: 1105 - protein, 16 aa, Artificial
  Consensus peptide
TAPTVDLNQVLNETRN

SEQ ID NO: 1106 - protein, 16 aa, Artificial
  Consensus peptide
TAPTVDLNRVLNETRS

SEQ ID NO: 1107 - protein, 16 aa, Artificial
  Consensus peptide
TAPTVDLNRVLNETRN

SEQ ID NO: 1108 - protein, 16 aa, Artificial
  Consensus peptide
APTVDLNQVLNETRSQ

SEQ ID NO: 1109 - protein, 16 aa, Artificial
  Consensus peptide
APTVDLNQVLNETRNQ

SEQ ID NO: 1110 - protein, 16 aa, Artificial
  Consensus peptide
APTVDLNRVLNETRSQ

SEQ ID NO: 1111 - protein, 16 aa, Artificial
  Consensus peptide
APTVDLNRVLNETRNQ

SEQ ID NO: 1112 - protein, 16 aa, Artificial
  Consensus peptide
PTVDLNQVLNETRSQY

SEQ ID NO: 1113 - protein, 16 aa, Artificial
  Consensus peptide
PTVDLNQVLNETRNQY

SEQ ID NO: 1114 - protein, 16 aa, Artificial
  Consensus peptide
PTVDLNRVLNETRSQY

SEQ ID NO: 1115 - protein, 16 aa, Artificial
  Consensus peptide
PTVDLNRVLNETRNQY

SEQ ID NO: 1116 - protein, 16 aa, Artificial
  Consensus peptide
TVDLNQVLNETRSQYE

SEQ ID NO: 1117 - protein, 16 aa, Artificial
  Consensus peptide
TVDLNQVLNETRNQYE

SEQ ID NO: 1118 - protein, 16 aa, Artificial
  Consensus peptide
TVDLNRVLNETRSQYE

SEQ ID NO: 1119 - protein, 16 aa, Artificial
  Consensus peptide
TVDLNRVLNETRNQYE

SEQ ID NO: 1120 - protein, 16 aa, Artificial
  Consensus peptide
VDLNQVLNETRSQYEA

SEQ ID NO: 1121 - protein, 16 aa, Artificial
  Consensus peptide
VDLNQVLNETRNQYEA

SEQ ID NO: 1122 - protein, 16 aa, Artificial
  Consensus peptide
VDLNRVLNETRSQYEA

SEQ ID NO: 1123 - protein, 16 aa, Artificial
  Consensus peptide
VDLNRVLNETRNQYEA

SEQ ID NO: 1124 - protein, 16 aa, Artificial
  Consensus peptide
DLNQVLNETRSQYEAL

SEQ ID NO: 1125 - protein, 16 aa, Artificial
  Consensus peptide
DLNQVLNETRNQYEAL

SEQ ID NO: 1126 - protein, 16 aa, Artificial
  Consensus peptide
DLNRVLNETRSQYEAL

SEQ ID NO: 1127 - protein, 16 aa, Artificial
  Consensus peptide
DLNRVLNETRNQYEAL

SEQ ID NO: 1128 - protein, 17 aa, Artificial
  Consensus peptide
EVNTLRCQLGDRLNVEV

SEQ ID NO: 1129 - protein, 17 aa, Artificial
  Consensus peptide
EVNTLRCPLGDRLNVEV

SEQ ID NO: 1130 - protein, 17 aa, Artificial
  Consensus peptide
EVNTLRSQLGDRLNVEV

SEQ ID NO: 1131 - protein, 17 aa, Artificial
  Consensus peptide
EVNTLRSPLGDRLNVEV

SEQ ID NO: 1132 - protein, 17 aa, Artificial
  Consensus peptide
VNTLRCQLGDRLNVEVD

SEQ ID NO: 1133 - protein, 17 aa, Artificial
  Consensus peptide
VNTLRCPLGDRLNVEVD

SEQ ID NO: 1134 - protein, 17 aa, Artificial
  Consensus peptide
VNTLRSQLGDRLNVEVD

SEQ ID NO: 1135 - protein, 17 aa, Artificial
  Consensus peptide
VNTLRSPLGDRLNVEVD

SEQ ID NO: 1136 - protein, 17 aa, Artificial
  Consensus peptide
NTLRCQLGDRLNVEVDA

SEQ ID NO: 1137 - protein, 17 aa, Artificial
  Consensus peptide
NTLRCQLGDRLNVEVDT

SEQ ID NO: 1138 - protein, 17 aa, Artificial
  Consensus peptide
NTLRCPLGDRLNVEVDA

SEQ ID NO: 1139 - protein, 17 aa, Artificial
  Consensus peptide
NTLRCPLGDRLNVEVDT

SEQ ID NO: 1140 - protein, 17 aa, Artificial
  Consensus peptide
NTLRSQLGDRLNVEVDA

SEQ ID NO: 1141 - protein, 17 aa, Artificial
  Consensus peptide
NTLRSQLGDRLNVEVDT

SEQ ID NO: 1142 - protein, 17 aa, Artificial
  Consensus peptide
NTLRSPLGDRLNVEVDA

SEQ ID NO: 1143 - protein, 17 aa, Artificial
  Consensus peptide
NTLRSPLGDRLNVEVDT

SEQ ID NO: 1144 - protein, 17 aa, Artificial
  Consensus peptide
TLRCQLGDRLNVEVDAA

SEQ ID NO: 1145 - protein, 17 aa, Artificial
  Consensus peptide
TLRCQLGDRLNVEVDTA

SEQ ID NO: 1146 - protein, 17 aa, Artificial
  Consensus peptide
TLRCPLGDRLNVEVDAA

SEQ ID NO: 1147 - protein, 17 aa, Artificial
  Consensus peptide
TLRCPLGDRLNVEVDTA

SEQ ID NO: 1148 - protein, 17 aa, Artificial
  Consensus peptide
TLRSQLGDRLNVEVDAA

SEQ ID NO: 1149 - protein, 17 aa, Artificial
  Consensus peptide
TLRSQLGDRLNVEVDTA

SEQ ID NO: 1150 - protein, 17 aa, Artificial
  Consensus peptide
TLRSPLGDRLNVEVDAA

SEQ ID NO: 1151 - protein, 17 aa, Artificial
  Consensus peptide
TLRSPLGDRLNVEVDTA

SEQ ID NO: 1152 - protein, 17 aa, Artificial
  Consensus peptide
LRCQLGDRLNVEVDAAP

SEQ ID NO: 1153 - protein, 17 aa, Artificial
  Consensus peptide
LRCQLGDRLNVEVDTAP

SEQ ID NO: 1154 - protein, 17 aa, Artificial
  Consensus peptide
LRCPLGDRLNVEVDAAP

SEQ ID NO: 1155 - protein, 17 aa, Artificial
  Consensus peptide
LRCPLGDRLNVEVDTAP

SEQ ID NO: 1156 - protein, 17 aa, Artificial
  Consensus peptide
LRSQLGDRLNVEVDAAP

SEQ ID NO: 1157 - protein, 17 aa, Artificial
  Consensus peptide
LRSQLGDRLNVEVDTAP

SEQ ID NO: 1158 - protein, 17 aa, Artificial
  Consensus peptide
LRSPLGDRLNVEVDAAP

SEQ ID NO: 1159 - protein, 17 aa, Artificial
  Consensus peptide
LRSPLGDRLNVEVDTAP

SEQ ID NO: 1160 - protein, 17 aa, Artificial
  Consensus peptide
RCQLGDRLNVEVDAAPT

SEQ ID NO: 1161 - protein, 17 aa, Artificial
  Consensus peptide
RCQLGDRLNVEVDTAPT

SEQ ID NO: 1162 - protein, 17 aa, Artificial
  Consensus peptide
RCPLGDRLNVEVDAAPT

SEQ ID NO: 1163 - protein, 17 aa, Artificial
  Consensus peptide
RCPLGDRLNVEVDTAPT

SEQ ID NO: 1164 - protein, 17 aa, Artificial
  Consensus peptide
RSQLGDRLNVEVDAAPT

SEQ ID NO: 1165 - protein, 17 aa, Artificial
  Consensus peptide
RSQLGDRLNVEVDTAPT

SEQ ID NO: 1166 - protein, 17 aa, Artificial
  Consensus peptide
RSPLGDRLNVEVDAAPT

SEQ ID NO: 1167 - protein, 17 aa, Artificial
  Consensus peptide
RSPLGDRLNVEVDTAPT

SEQ ID NO: 1168 - protein, 17 aa, Artificial
  Consensus peptide
CQLGDRLNVEVDAAPTV

SEQ ID NO: 1169 - protein, 17 aa, Artificial
  Consensus peptide
CQLGDRLNVEVDTAPTV

SEQ ID NO: 1170 - protein, 17 aa, Artificial
  Consensus peptide
CPLGDRLNVEVDAAPTV

SEQ ID NO: 1171 - protein, 17 aa, Artificial
  Consensus peptide
CPLGDRLNVEVDTAPTV

SEQ ID NO: 1172 - protein, 17 aa, Artificial
  Consensus peptide
SQLGDRLNVEVDAAPTV

SEQ ID NO: 1173 - protein, 17 aa, Artificial
  Consensus peptide
SQLGDRLNVEVDTAPTV

SEQ ID NO: 1174 - protein, 17 aa, Artificial
  Consensus peptide
SPLGDRLNVEVDAAPTV

SEQ ID NO: 1175 - protein, 17 aa, Artificial
  Consensus peptide
SPLGDRLNVEVDTAPTV

SEQ ID NO: 1176 - protein, 17 aa, Artificial
  Consensus peptide
QLGDRLNVEVDAAPTVD

SEQ ID NO: 1177 - protein, 17 aa, Artificial
  Consensus peptide
QLGDRLNVEVDTAPTVD

SEQ ID NO: 1178 - protein, 17 aa, Artificial
  Consensus peptide
PLGDRLNVEVDAAPTVD

SEQ ID NO: 1179 - protein, 17 aa, Artificial
  Consensus peptide
PLGDRLNVEVDTAPTVD

SEQ ID NO: 1180 - protein, 17 aa, Artificial
  Consensus peptide
LGDRLNVEVDAAPTVDL

SEQ ID NO: 1181 - protein, 17 aa, Artificial
  Consensus peptide
LGDRLNVEVDTAPTVDL

SEQ ID NO: 1182 - protein, 17 aa, Artificial
  Consensus peptide
GDRLNVEVDAAPTVDLN

SEQ ID NO: 1183 - protein, 17 aa, Artificial
  Consensus peptide
GDRLNVEVDTAPTVDLN

SEQ ID NO: 1184 - protein, 17 aa, Artificial
  Consensus peptide
DRLNVEVDAAPTVDLNQ

SEQ ID NO: 1185 - protein, 17 aa, Artificial
  Consensus peptide
DRLNVEVDAAPTVDLNR

SEQ ID NO: 1186 - protein, 17 aa, Artificial
  Consensus peptide
DRLNVEVDTAPTVDLNQ

SEQ ID NO: 1187 - protein, 17 aa, Artificial
  Consensus peptide
DRLNVEVDTAPTVDLNR

SEQ ID NO: 1188 - protein, 17 aa, Artificial
  Consensus peptide
RLNVEVDAAPTVDLNQV

SEQ ID NO: 1189 - protein, 17 aa, Artificial
  Consensus peptide
RLNVEVDAAPTVDLNRV

SEQ ID NO: 1190 - protein, 17 aa, Artificial
  Consensus peptide
RLNVEVDTAPTVDLNQV

SEQ ID NO: 1191 - protein, 17 aa, Artificial
  Consensus peptide
RLNVEVDTAPTVDLNRV

SEQ ID NO: 1192 - protein, 17 aa, Artificial
  Consensus peptide
LNVEVDAAPTVDLNQVL

SEQ ID NO: 1193 - protein, 17 aa, Artificial
  Consensus peptide
LNVEVDAAPTVDLNRVL

SEQ ID NO: 1194 - protein, 17 aa, Artificial
  Consensus peptide
LNVEVDTAPTVDLNQVL

SEQ ID NO: 1195 - protein, 17 aa, Artificial
  Consensus peptide
LNVEVDTAPTVDLNRVL

SEQ ID NO: 1196 - protein, 17 aa, Artificial
  Consensus peptide
NVEVDAAPTVDLNQVLN

SEQ ID NO: 1197 - protein, 17 aa, Artificial
  Consensus peptide
NVEVDAAPTVDLNRVLN

SEQ ID NO: 1198 - protein, 17 aa, Artificial
  Consensus peptide
NVEVDTAPTVDLNQVLN

SEQ ID NO: 1199 - protein, 17 aa, Artificial
  Consensus peptide
NVEVDTAPTVDLNRVLN

SEQ ID NO: 1200 - protein, 17 aa, Artificial
  Consensus peptide
VEVDAAPTVDLNQVLNE

SEQ ID NO: 1201 - protein, 17 aa, Artificial
  Consensus peptide
VEVDAAPTVDLNRVLNE

SEQ ID NO: 1202 - protein, 17 aa, Artificial
  Consensus peptide
VEVDTAPTVDLNQVLNE

SEQ ID NO: 1203 - protein, 17 aa, Artificial
  Consensus peptide
VEVDTAPTVDLNRVLNE

SEQ ID NO: 1204 - protein, 17 aa, Artificial
  Consensus peptide
EVDAAPTVDLNQVLNET

SEQ ID NO: 1205 - protein, 17 aa, Artificial
  Consensus peptide
EVDAAPTVDLNRVLNET

SEQ ID NO: 1206 - protein, 17 aa, Artificial
  Consensus peptide
EVDTAPTVDLNQVLNET

SEQ ID NO: 1207 - protein, 17 aa, Artificial
  Consensus peptide
EVDTAPTVDLNRVLNET

SEQ ID NO: 1208 - protein, 17 aa, Artificial
  Consensus peptide
VDAAPTVDLNQVLNETR

SEQ ID NO: 1209 - protein, 17 aa, Artificial
  Consensus peptide
VDAAPTVDLNRVLNETR

SEQ ID NO: 1210 - protein, 17 aa, Artificial
  Consensus peptide
VDTAPTVDLNQVLNETR

SEQ ID NO: 1211 - protein, 17 aa, Artificial
  Consensus peptide
VDTAPTVDLNRVLNETR

SEQ ID NO: 1212 - protein, 17 aa, Artificial
  Consensus peptide
DAAPTVDLNQVLNETRS

SEQ ID NO: 1213 - protein, 17 aa, Artificial
  Consensus peptide
DAAPTVDLNQVLNETRN

SEQ ID NO: 1214 - protein, 17 aa, Artificial
  Consensus peptide
DAAPTVDLNRVLNETRS

SEQ ID NO: 1215 - protein, 17 aa, Artificial
  Consensus peptide
DAAPTVDLNRVLNETRN

SEQ ID NO: 1216 - protein, 17 aa, Artificial
  Consensus peptide
DTAPTVDLNQVLNETRS

SEQ ID NO: 1217 - protein, 17 aa, Artificial
  Consensus peptide
DTAPTVDLNQVLNETRN

SEQ ID NO: 1218 - protein, 17 aa, Artificial
  Consensus peptide
DTAPTVDLNRVLNETRS

SEQ ID NO: 1219 - protein, 17 aa, Artificial
  Consensus peptide
DTAPTVDLNRVLNETRN

SEQ ID NO: 1220 - protein, 17 aa, Artificial
  Consensus peptide
AAPTVDLNQVLNETRSQ

SEQ ID NO: 1221 - protein, 17 aa, Artificial
  Consensus peptide
AAPTVDLNQVLNETRNQ

SEQ ID NO: 1222 - protein, 17 aa, Artificial
  Consensus peptide
AAPTVDLNRVLNETRSQ

SEQ ID NO: 1223 - protein, 17 aa, Artificial
  Consensus peptide
AAPTVDLNRVLNETRNQ

SEQ ID NO: 1224 - protein, 17 aa, Artificial
  Consensus peptide
TAPTVDLNQVLNETRSQ

SEQ ID NO: 1225 - protein, 17 aa, Artificial
  Consensus peptide
TAPTVDLNQVLNETRNQ

SEQ ID NO: 1226 - protein, 17 aa, Artificial
  Consensus peptide
TAPTVDLNRVLNETRSQ

SEQ ID NO: 1227 - protein, 17 aa, Artificial
  Consensus peptide
TAPTVDLNRVLNETRNQ

SEQ ID NO: 1228 - protein, 17 aa, Artificial
  Consensus peptide
APTVDLNQVLNETRSQY

SEQ ID NO: 1229 - protein, 17 aa, Artificial
  Consensus peptide
APTVDLNQVLNETRNQY

SEQ ID NO: 1230 - protein, 17 aa, Artificial
  Consensus peptide
APTVDLNRVLNETRSQY

SEQ ID NO: 1231 - protein, 17 aa, Artificial
  Consensus peptide
APTVDLNRVLNETRNQY

SEQ ID NO: 1232 - protein, 17 aa, Artificial
  Consensus peptide
PTVDLNQVLNETRSQYE

SEQ ID NO: 1233 - protein, 17 aa, Artificial
  Consensus peptide
PTVDLNQVLNETRNQYE

SEQ ID NO: 1234 - protein, 17 aa, Artificial
  Consensus peptide
PTVDLNRVLNETRSQYE

SEQ ID NO: 1235 - protein, 17 aa, Artificial
  Consensus peptide
PTVDLNRVLNETRNQYE

SEQ ID NO: 1236 - protein, 17 aa, Artificial
  Consensus peptide
TVDLNQVLNETRSQYEA

SEQ ID NO: 1237 - protein, 17 aa, Artificial
  Consensus peptide
TVDLNQVLNETRNQYEA

SEQ ID NO: 1238 - protein, 17 aa, Artificial
  Consensus peptide
TVDLNRVLNETRSQYEA

SEQ ID NO: 1239 - protein, 17 aa, Artificial
  Consensus peptide
TVDLNRVLNETRNQYEA

SEQ ID NO: 1240 - protein, 17 aa, Artificial
  Consensus peptide
VDLNQVLNETRSQYEAL

SEQ ID NO: 1241 - protein, 17 aa, Artificial
  Consensus peptide
VDLNQVLNETRNQYEAL

SEQ ID NO: 1242 - protein, 17 aa, Artificial
  Consensus peptide
VDLNRVLNETRSQYEAL

SEQ ID NO: 1243 - protein, 17 aa, Artificial
  Consensus peptide
VDLNRVLNETRNQYEAL

SEQ ID NO: 1244 - protein, 18 aa, Artificial
  Consensus peptide
EVNTLRCQLGDRLNVEVD

SEQ ID NO: 1245 - protein, 18 aa, Artificial
  Consensus peptide
EVNTLRCPLGDRLNVEVD

SEQ ID NO: 1246 - protein, 18 aa, Artificial
  Consensus peptide
EVNTLRSQLGDRLNVEVD

SEQ ID NO: 1247 - protein, 18 aa, Artificial
  Consensus peptide
EVNTLRSPLGDRLNVEVD

SEQ ID NO: 1248 - protein, 18 aa, Artificial
  Consensus peptide
VNTLRCQLGDRLNVEVDA

SEQ ID NO: 1249 - protein, 18 aa, Artificial
  Consensus peptide
VNTLRCQLGDRLNVEVDT

SEQ ID NO: 1250 - protein, 18 aa, Artificial
  Consensus peptide
VNTLRCPLGDRLNVEVDA

SEQ ID NO: 1251 - protein, 18 aa, Artificial
  Consensus peptide
VNTLRCPLGDRLNVEVDT

SEQ ID NO: 1252 - protein, 18 aa, Artificial
  Consensus peptide
VNTLRSQLGDRLNVEVDA

SEQ ID NO: 1253 - protein, 18 aa, Artificial
  Consensus peptide
VNTLRSQLGDRLNVEVDT

SEQ ID NO: 1254 - protein, 18 aa, Artificial
  Consensus peptide
VNTLRSPLGDRLNVEVDA

SEQ ID NO: 1255 - protein, 18 aa, Artificial
  Consensus peptide
VNTLRSPLGDRLNVEVDT

SEQ ID NO: 1256 - protein, 18 aa, Artificial
  Consensus peptide
NTLRCQLGDRLNVEVDAA

SEQ ID NO: 1257 - protein, 18 aa, Artificial
  Consensus peptide
NTLRCQLGDRLNVEVDTA

SEQ ID NO: 1258 - protein, 18 aa, Artificial
  Consensus peptide
NTLRCPLGDRLNVEVDAA

SEQ ID NO: 1259 - protein, 18 aa, Artificial
  Consensus peptide
NTLRCPLGDRLNVEVDTA

SEQ ID NO: 1260 - protein, 18 aa, Artificial
  Consensus peptide
NTLRSQLGDRLNVEVDAA

SEQ ID NO: 1261 - protein, 18 aa, Artificial
  Consensus peptide
NTLRSQLGDRLNVEVDTA

SEQ ID NO: 1262 - protein, 18 aa, Artificial
  Consensus peptide
NTLRSPLGDRLNVEVDAA

SEQ ID NO: 1263 - protein, 18 aa, Artificial
  Consensus peptide
NTLRSPLGDRLNVEVDTA

SEQ ID NO: 1264 - protein, 18 aa, Artificial
  Consensus peptide
TLRCQLGDRLNVEVDAAP

SEQ ID NO: 1265 - protein, 18 aa, Artificial
  Consensus peptide
TLRCQLGDRLNVEVDTAP

SEQ ID NO: 1266 - protein, 18 aa, Artificial
  Consensus peptide
TLRCPLGDRLNVEVDAAP

SEQ ID NO: 1267 - protein, 18 aa, Artificial
  Consensus peptide
TLRCPLGDRLNVEVDTAP

SEQ ID NO: 1268 - protein, 18 aa, Artificial
  Consensus peptide
TLRSQLGDRLNVEVDAAP

SEQ ID NO: 1269 - protein, 18 aa, Artificial
  Consensus peptide
TLRSQLGDRLNVEVDTAP

SEQ ID NO: 1270 - protein, 18 aa, Artificial
  Consensus peptide
TLRSPLGDRLNVEVDAAP

SEQ ID NO: 1271 - protein, 18 aa, Artificial
  Consensus peptide
TLRSPLGDRLNVEVDTAP

SEQ ID NO: 1272 - protein, 18 aa, Artificial
  Consensus peptide
LRCQLGDRLNVEVDAAPT

SEQ ID NO: 1273 - protein, 18 aa, Artificial
  Consensus peptide
LRCQLGDRLNVEVDTAPT

SEQ ID NO: 1274 - protein, 18 aa, Artificial
  Consensus peptide
LRCPLGDRLNVEVDAAPT

SEQ ID NO: 1275 - protein, 18 aa, Artificial
  Consensus peptide
LRCPLGDRLNVEVDTAPT

SEQ ID NO: 1276 - protein, 18 aa, Artificial
  Consensus peptide
LRSQLGDRLNVEVDAAPT

SEQ ID NO: 1277 - protein, 18 aa, Artificial
  Consensus peptide
LRSQLGDRLNVEVDTAPT

SEQ ID NO: 1278 - protein, 18 aa, Artificial
  Consensus peptide
LRSPLGDRLNVEVDAAPT

SEQ ID NO: 1279 - protein, 18 aa, Artificial
  Consensus peptide
LRSPLGDRLNVEVDTAPT

SEQ ID NO: 1280 - protein, 18 aa, Artificial
  Consensus peptide
RCQLGDRLNVEVDAAPTV

SEQ ID NO: 1281 - protein, 18 aa, Artificial
  Consensus peptide
RCQLGDRLNVEVDTAPTV

SEQ ID NO: 1282 - protein, 18 aa, Artificial
  Consensus peptide
RCPLGDRLNVEVDAAPTV

SEQ ID NO: 1283 - protein, 18 aa, Artificial
  Consensus peptide
RCPLGDRLNVEVDTAPTV

SEQ ID NO: 1284 - protein, 18 aa, Artificial
  Consensus peptide
RSQLGDRLNVEVDAAPTV

SEQ ID NO: 1285 - protein, 18 aa, Artificial
  Consensus peptide
RSQLGDRLNVEVDTAPTV

SEQ ID NO: 1286 - protein, 18 aa, Artificial
  Consensus peptide
RSPLGDRLNVEVDAAPTV

SEQ ID NO: 1287 - protein, 18 aa, Artificial
  Consensus peptide
RSPLGDRLNVEVDTAPTV

SEQ ID NO: 1288 - protein, 18 aa, Artificial
  Consensus peptide
CQLGDRLNVEVDAAPTVD

SEQ ID NO: 1289 - protein, 18 aa, Artificial
  Consensus peptide
CQLGDRLNVEVDTAPTVD

SEQ ID NO: 1290 - protein, 18 aa, Artificial
  Consensus peptide
CPLGDRLNVEVDAAPTVD

SEQ ID NO: 1291 - protein, 18 aa, Artificial
  Consensus peptide
CPLGDRLNVEVDTAPTVD

SEQ ID NO: 1292 - protein, 18 aa, Artificial
  Consensus peptide
SQLGDRLNVEVDAAPTVD

SEQ ID NO: 1293 - protein, 18 aa, Artificial
  Consensus peptide
SQLGDRLNVEVDTAPTVD

SEQ ID NO: 1294 - protein, 18 aa, Artificial
  Consensus peptide
SPLGDRLNVEVDAAPTVD

SEQ ID NO: 1295 - protein, 18 aa, Artificial
  Consensus peptide
SPLGDRLNVEVDTAPTVD

SEQ ID NO: 1296 - protein, 18 aa, Artificial
  Consensus peptide
QLGDRLNVEVDAAPTVDL

SEQ ID NO: 1297 - protein, 18 aa, Artificial
  Consensus peptide
QLGDRLNVEVDTAPTVDL

SEQ ID NO: 1298 - protein, 18 aa, Artificial
  Consensus peptide
PLGDRLNVEVDAAPTVDL

SEQ ID NO: 1299 - protein, 18 aa, Artificial
  Consensus peptide
PLGDRLNVEVDTAPTVDL

SEQ ID NO: 1300 - protein, 18 aa, Artificial
  Consensus peptide
LGDRLNVEVDAAPTVDLN

SEQ ID NO: 1301 - protein, 18 aa, Artificial
  Consensus peptide
LGDRLNVEVDTAPTVDLN

SEQ ID NO: 1302 - protein, 18 aa, Artificial
  Consensus peptide
GDRLNVEVDAAPTVDLNQ

SEQ ID NO: 1303 - protein, 18 aa, Artificial
  Consensus peptide
GDRLNVEVDAAPTVDLNR

SEQ ID NO: 1304 - protein, 18 aa, Artificial
  Consensus peptide
GDRLNVEVDTAPTVDLNQ

SEQ ID NO: 1305 - protein, 18 aa, Artificial
  Consensus peptide
GDRLNVEVDTAPTVDLNR

SEQ ID NO: 1306 - protein, 18 aa, Artificial
  Consensus peptide
DRLNVEVDAAPTVDLNQV

SEQ ID NO: 1307 - protein, 18 aa, Artificial
  Consensus peptide
DRLNVEVDAAPTVDLNRV

SEQ ID NO: 1308 - protein, 18 aa, Artificial
  Consensus peptide
DRLNVEVDTAPTVDLNQV

SEQ ID NO: 1309 - protein, 18 aa, Artificial
  Consensus peptide
DRLNVEVDTAPTVDLNRV

SEQ ID NO: 1310 - protein, 18 aa, Artificial
  Consensus peptide
RLNVEVDAAPTVDLNQVL

SEQ ID NO: 1311 - protein, 18 aa, Artificial
  Consensus peptide
RLNVEVDAAPTVDLNRVL

SEQ ID NO: 1312 - protein, 18 aa, Artificial
  Consensus peptide
RLNVEVDTAPTVDLNQVL

SEQ ID NO: 1313 - protein, 18 aa, Artificial
  Consensus peptide
RLNVEVDTAPTVDLNRVL

SEQ ID NO: 1314 - protein, 18 aa, Artificial
  Consensus peptide
LNVEVDAAPTVDLNQVLN

SEQ ID NO: 1315 - protein, 18 aa, Artificial
  Consensus peptide
LNVEVDAAPTVDLNRVLN

SEQ ID NO: 1316 - protein, 18 aa, Artificial
  Consensus peptide
LNVEVDTAPTVDLNQVLN

SEQ ID NO: 1317 - protein, 18 aa, Artificial
  Consensus peptide
LNVEVDTAPTVDLNRVLN

SEQ ID NO: 1318 - protein, 18 aa, Artificial
  Consensus peptide
NVEVDAAPTVDLNQVLNE

SEQ ID NO: 1319 - protein, 18 aa, Artificial
  Consensus peptide
NVEVDAAPTVDLNRVLNE

SEQ ID NO: 1320 - protein, 18 aa, Artificial
  Consensus peptide
NVEVDTAPTVDLNQVLNE

SEQ ID NO: 1321 - protein, 18 aa, Artificial
  Consensus peptide
NVEVDTAPTVDLNRVLNE

SEQ ID NO: 1322 - protein, 18 aa, Artificial
  Consensus peptide
VEVDAAPTVDLNQVLNET

SEQ ID NO: 1323 - protein, 18 aa, Artificial
  Consensus peptide
VEVDAAPTVDLNRVLNET

SEQ ID NO: 1324 - protein, 18 aa, Artificial
  Consensus peptide
VEVDTAPTVDLNQVLNET

SEQ ID NO: 1325 - protein, 18 aa, Artificial
  Consensus peptide
VEVDTAPTVDLNRVLNET

SEQ ID NO: 1326 - protein, 18 aa, Artificial
  Consensus peptide
EVDAAPTVDLNQVLNETR

SEQ ID NO: 1327 - protein, 18 aa, Artificial
  Consensus peptide
EVDAAPTVDLNRVLNETR

SEQ ID NO: 1328 - protein, 18 aa, Artificial
  Consensus peptide
EVDTAPTVDLNQVLNETR

SEQ ID NO: 1329 - protein, 18 aa, Artificial
  Consensus peptide
EVDTAPTVDLNRVLNETR

SEQ ID NO: 1330 - protein, 18 aa, Artificial
  Consensus peptide
VDAAPTVDLNQVLNETRS

SEQ ID NO: 1331 - protein, 18 aa, Artificial
  Consensus peptide
VDAAPTVDLNQVLNETRN

SEQ ID NO: 1332 - protein, 18 aa, Artificial
  Consensus peptide
VDAAPTVDLNRVLNETRS

SEQ ID NO: 1333 - protein, 18 aa, Artificial
  Consensus peptide
VDAAPTVDLNRVLNETRN

SEQ ID NO: 1334 - protein, 18 aa, Artificial
  Consensus peptide
VDTAPTVDLNQVLNETRS

SEQ ID NO: 1335 - protein, 18 aa, Artificial
  Consensus peptide
VDTAPTVDLNQVLNETRN

SEQ ID NO: 1336 - protein, 18 aa, Artificial
  Consensus peptide
VDTAPTVDLNRVLNETRS

SEQ ID NO: 1337 - protein, 18 aa, Artificial
  Consensus peptide
VDTAPTVDLNRVLNETRN

SEQ ID NO: 1338 - protein, 18 aa, Artificial
  Consensus peptide
DAAPTVDLNQVLNETRSQ

SEQ ID NO: 1339 - protein, 18 aa, Artificial
  Consensus peptide
DAAPTVDLNQVLNETRNQ

SEQ ID NO: 1340 - protein, 18 aa, Artificial
  Consensus peptide
DAAPTVDLNRVLNETRSQ

SEQ ID NO: 1341 - protein, 18 aa, Artificial
  Consensus peptide
DAAPTVDLNRVLNETRNQ

SEQ ID NO: 1342 - protein, 18 aa, Artificial
  Consensus peptide
DTAPTVDLNQVLNETRSQ

SEQ ID NO: 1343 - protein, 18 aa, Artificial
  Consensus peptide
DTAPTVDLNQVLNETRNQ

SEQ ID NO: 1344 - protein, 18 aa, Artificial
  Consensus peptide
DTAPTVDLNRVLNETRSQ

SEQ ID NO: 1345 - protein, 18 aa, Artificial
  Consensus peptide
DTAPTVDLNRVLNETRNQ

SEQ ID NO: 1346 - protein, 18 aa, Artificial
  Consensus peptide
AAPTVDLNQVLNETRSQY

SEQ ID NO: 1347 - protein, 18 aa, Artificial
  Consensus peptide
AAPTVDLNQVLNETRNQY

SEQ ID NO: 1348 - protein, 18 aa, Artificial
  Consensus peptide
AAPTVDLNRVLNETRSQY

SEQ ID NO: 1349 - protein, 18 aa, Artificial
  Consensus peptide
AAPTVDLNRVLNETRNQY

SEQ ID NO: 1350 - protein, 18 aa, Artificial
  Consensus peptide
TAPTVDLNQVLNETRSQY

SEQ ID NO: 1351 - protein, 18 aa, Artificial
  Consensus peptide
TAPTVDLNQVLNETRNQY

SEQ ID NO: 1352 - protein, 18 aa, Artificial
  Consensus peptide
TAPTVDLNRVLNETRSQY

SEQ ID NO: 1353 - protein, 18 aa, Artificial
  Consensus peptide
TAPTVDLNRVLNETRNQY

SEQ ID NO: 1354 - protein, 18 aa, Artificial
  Consensus peptide
APTVDLNQVLNETRSQYE

SEQ ID NO: 1355 - protein, 18 aa, Artificial
  Consensus peptide
APTVDLNQVLNETRNQYE

SEQ ID NO: 1356 - protein, 18 aa, Artificial
  Consensus peptide
APTVDLNRVLNETRSQYE

SEQ ID NO: 1357 - protein, 18 aa, Artificial
  Consensus peptide
APTVDLNRVLNETRNQYE

SEQ ID NO: 1358 - protein, 18 aa, Artificial
  Consensus peptide
PTVDLNQVLNETRSQYEA

SEQ ID NO: 1359 - protein, 18 aa, Artificial
  Consensus peptide
PTVDLNQVLNETRSQYEA

SEQ ID NO: 1360 - protein, 18 aa, Artificial
  Consensus peptide
PTVDLNRVLNETRSQYEA

SEQ ID NO: 1361 - protein, 18 aa, Artificial
  Consensus peptide
PTVDLNRVLNETRNQYEA

SEQ ID NO: 1362 - protein, 18 aa, Artificial
  Consensus peptide
TVDLNQVLNETRSQYEAL

SEQ ID NO: 1363 - protein, 18 aa, Artificial
  Consensus peptide
TVDLNQVLNETRNQYEAL

SEQ ID NO: 1364 - protein, 18 aa, Artificial
  Consensus peptide
TVDLNRVLNETRSQYEAL

SEQ ID NO: 1365 - protein, 18 aa, Artificial
  Consensus peptide
TVDLNRVLNETRNQYEAL

SEQ ID NO: 1366 - protein, 19 aa, Artificial
  Consensus peptide
EVNTLRCQLGDRLNVEVDA

SEQ ID NO: 1367 - protein, 19 aa, Artificial
  Consensus peptide
EVNTLRCQLGDRLNVEVDT

SEQ ID NO: 1368 - protein, 19 aa, Artificial
  Consensus peptide
EVNTLRCPLGDRLNVEVDA

SEQ ID NO: 1369 - protein, 19 aa, Artificial
  Consensus peptide
EVNTLRCPLGDRLNVEVDT

SEQ ID NO: 1370 - protein, 19 aa, Artificial
  Consensus peptide
EVNTLRSQLGDRLNVEVDA

SEQ ID NO: 1371 - protein, 19 aa, Artificial
  Consensus peptide
EVNTLRSQLGDRLNVEVDT

SEQ ID NO: 1372 - protein, 19 aa, Artificial
  Consensus peptide
EVNTLRSPLGDRLNVEVDA

SEQ ID NO: 1373 - protein, 19 aa, Artificial
  Consensus peptide
EVNTLRSPLGDRLNVEVDT

SEQ ID NO: 1374 - protein, 19 aa, Artificial
  Consensus peptide
VNTLRCQLGDRLNVEVDAA

SEQ ID NO: 1375 - protein, 19 aa, Artificial
  Consensus peptide
VNTLRCQLGDRLNVEVDTA

SEQ ID NO: 1376 - protein, 19 aa, Artificial
  Consensus peptide
VNTLRCPLGDRLNVEVDAA

SEQ ID NO: 1377 - protein, 19 aa, Artificial
  Consensus peptide
VNTLRCPLGDRLNVEVDTA

SEQ ID NO: 1378 - protein, 19 aa, Artificial
  Consensus peptide
VNTLRSQLGDRLNVEVDAA

SEQ ID NO: 1379 - protein, 19 aa, Artificial
  Consensus peptide
VNTLRSQLGDRLNVEVDTA

SEQ ID NO: 1380 - protein, 19 aa, Artificial
  Consensus peptide
VNTLRSPLGDRLNVEVDAA

SEQ ID NO: 1381 - protein, 19 aa, Artificial
  Consensus peptide
VNTLRSPLGDRLNVEVDTA

SEQ ID NO: 1382 - protein, 19 aa, Artificial
  Consensus peptide
VNTLRCQLGDRLNVEVDAA

SEQ ID NO: 1383 - protein, 19 aa, Artificial
  Consensus peptide
VNTLRCQLGDRLNVEVDTA

SEQ ID NO: 1384 - protein, 19 aa, Artificial
  Consensus peptide
VNTLRCPLGDRLNVEVDAA

SEQ ID NO: 1385 - protein, 19 aa, Artificial
  Consensus peptide
VNTLRCPLGDRLNVEVDTA

SEQ ID NO: 1386 - protein, 19 aa, Artificial
  Consensus peptide
VNTLRSQLGDRLNVEVDAA

SEQ ID NO: 1387 - protein, 19 aa, Artificial
  Consensus peptide
VNTLRSQLGDRLNVEVDTA

SEQ ID NO: 1388 - protein, 19 aa, Artificial
  Consensus peptide
VNTLRSPLGDRLNVEVDAA

SEQ ID NO: 1389 - protein, 19 aa, Artificial
  Consensus peptide
VNTLRSPLGDRLNVEVDTA

SEQ ID NO: 1390 - protein, 19 aa, Artificial
  Consensus peptide
TLRCQLGDRLNVEVDAAPT

SEQ ID NO: 1391 - protein, 19 aa, Artificial
  Consensus peptide
TLRCQLGDRLNVEVDTAPT

SEQ ID NO: 1392 - protein, 19 aa, Artificial
  Consensus peptide
TLRCPLGDRLNVEVDAAPT

SEQ ID NO: 1393 - protein, 19 aa, Artificial
  Consensus peptide
TLRCPLGDRLNVEVDTAPT

SEQ ID NO: 1394 - protein, 19 aa, Artificial
  Consensus peptide
TLRSQLGDRLNVEVDAAPT

SEQ ID NO: 1395 - protein, 19 aa, Artificial
  Consensus peptide
TLRSQLGDRLNVEVDTAPT

SEQ ID NO: 1396 - protein, 19 aa, Artificial
  Consensus peptide
TLRSPLGDRLNVEVDAAPT

SEQ ID NO: 1397 - protein, 19 aa, Artificial
  Consensus peptide
TLRSPLGDRLNVEVDTAPT

SEQ ID NO: 1398 - protein, 19 aa, Artificial
  Consensus peptide
LRCQLGDRLNVEVDAAPTV

SEQ ID NO: 1399 - protein, 19 aa, Artificial
  Consensus peptide
LRCQLGDRLNVEVDTAPTV

SEQ ID NO: 1400 - protein, 19 aa, Artificial
  Consensus peptide
LRCPLGDRLNVEVDAAPTV

SEQ ID NO: 1401 - protein, 19 aa, Artificial
  Consensus peptide
LRCPLGDRLNVEVDTAPTV

SEQ ID NO: 1402 - protein, 19 aa, Artificial
  Consensus peptide
LRSQLGDRLNVEVDAAPTV

SEQ ID NO: 1403 - protein, 19 aa, Artificial
  Consensus peptide
LRSQLGDRLNVEVDTAPTV

SEQ ID NO: 1404 - protein, 19 aa, Artificial
  Consensus peptide
LRSPLGDRLNVEVDAAPTV

SEQ ID NO: 1405 - protein, 19 aa, Artificial
  Consensus peptide
LRSPLGDRLNVEVDTAPTV

SEQ ID NO: 1406 - protein, 19 aa, Artificial
  Consensus peptide
LRCQLGDRLNVEVDAAPTV

SEQ ID NO: 1407 - protein, 19 aa, Artificial
  Consensus peptide
LRCQLGDRLNVEVDTAPTV

SEQ ID NO: 1408 - protein, 19 aa, Artificial
  Consensus peptide
LRCPLGDRLNVEVDAAPTV

SEQ ID NO: 1409 - protein, 19 aa, Artificial
  Consensus peptide
LRCPLGDRLNVEVDTAPTV

SEQ ID NO: 1410 - protein, 19 aa, Artificial
  Consensus peptide
LRSQLGDRLNVEVDAAPTV

SEQ ID NO: 1411 - protein, 19 aa, Artificial
  Consensus peptide
LRSQLGDRLNVEVDTAPTV

SEQ ID NO: 1412 - protein, 19 aa, Artificial
  Consensus peptide
LRSPLGDRLNVEVDAAPTV

SEQ ID NO: 1413 - protein, 19 aa, Artificial
  Consensus peptide
LRSPLGDRLNVEVDTAPTV

SEQ ID NO: 1414 - protein, 19 aa, Artificial
  Consensus peptide
LRCQLGDRLNVEVDAAPTV

SEQ ID NO: 1415 - protein, 19 aa, Artificial
  Consensus peptide
LRCQLGDRLNVEVDTAPTV

SEQ ID NO: 1416 - protein, 19 aa, Artificial
  Consensus peptide
LRCPLGDRLNVEVDAAPTV

SEQ ID NO: 1417 - protein, 19 aa, Artificial
  Consensus peptide
LRCPLGDRLNVEVDTAPTV

SEQ ID NO: 1418 - protein, 19 aa, Artificial
  Consensus peptide
LRSQLGDRLNVEVDAAPTV

SEQ ID NO: 1419 - protein, 19 aa, Artificial
  Consensus peptide
LRSQLGDRLNVEVDTAPTV

SEQ ID NO: 1420 - protein, 19 aa, Artificial
  Consensus peptide
LRSPLGDRLNVEVDAAPTV

SEQ ID NO: 1421 - protein, 19 aa, Artificial
  Consensus peptide
LRSPLGDRLNVEVDTAPTV

SEQ ID NO: 1422 - protein, 19 aa, Artificial
  Consensus peptide
QLGDRLNVEVDAAPTVDLN

SEQ ID NO: 1423 - protein, 19 aa, Artificial
  Consensus peptide
QLGDRLNVEVDTAPTVDLN

SEQ ID NO: 1424 - protein, 19 aa, Artificial
  Consensus peptide
PLGDRLNVEVDAAPTVDLN

SEQ ID NO: 1425 - protein, 19 aa, Artificial
  Consensus peptide
PLGDRLNVEVDTAPTVDLN

SEQ ID NO: 1426 - protein, 19 aa, Artificial
  Consensus peptide
LGDRLNVEVDAAPTVDLNQ

SEQ ID NO: 1427 - protein, 19 aa, Artificial
  Consensus peptide
LGDRLNVEVDAAPTVDLNR

SEQ ID NO: 1428 - protein, 19 aa, Artificial
  Consensus peptide
LGDRLNVEVDTAPTVDLNQ

SEQ ID NO: 1429 - protein, 19 aa, Artificial
  Consensus peptide
LGDRLNVEVDTAPTVDLNR

SEQ ID NO: 1430 - protein, 19 aa, Artificial
  Consensus peptide
GDRLNVEVDAAPTVDLNQV

SEQ ID NO: 1431 - protein, 19 aa, Artificial
  Consensus peptide
GDRLNVEVDAAPTVDLNRV

SEQ ID NO: 1432 - protein, 19 aa, Artificial
  Consensus peptide
GDRLNVEVDTAPTVDLNQV

SEQ ID NO: 1433 - protein, 19 aa, Artificial
  Consensus peptide
GDRLNVEVDTAPTVDLNRV

SEQ ID NO: 1434 - protein, 19 aa, Artificial
  Consensus peptide
DRLNVEVDAAPTVDLNQVL

SEQ ID NO: 1435 - protein, 19 aa, Artificial
  Consensus peptide
DRLNVEVDAAPTVDLNRVL

SEQ ID NO: 1436 - protein, 19 aa, Artificial
  Consensus peptide
DRLNVEVDTAPTVDLNQVL

SEQ ID NO: 1437 - protein, 19 aa, Artificial
  Consensus peptide
DRLNVEVDTAPTVDLNRVL

SEQ ID NO: 1438 - protein, 19 aa, Artificial
  Consensus peptide
RLNVEVDAAPTVDLNQVLN

SEQ ID NO: 1439 - protein, 19 aa, Artificial
  Consensus peptide
RLNVEVDAAPTVDLNRVLN

SEQ ID NO: 1440 - protein, 19 aa, Artificial
  Consensus peptide
RLNVEVDTAPTVDLNQVLN

SEQ ID NO: 1441 - protein, 19 aa, Artificial
  Consensus peptide
RLNVEVDTAPTVDLNRVLN

SEQ ID NO: 1442 - protein, 19 aa, Artificial
  Consensus peptide
LNVEVDAAPTVDLNQVLNE

SEQ ID NO: 1443 - protein, 19 aa, Artificial
  Consensus peptide
LNVEVDAAPTVDLNRVLNE

SEQ ID NO: 1444 - protein, 19 aa, Artificial
  Consensus peptide
LNVEVDTAPTVDLNQVLNE

SEQ ID NO: 1445 - protein, 19 aa, Artificial
  Consensus peptide
LNVEVDTAPTVDLNRVLNE

SEQ ID NO: 1446 - protein, 19 aa, Artificial
  Consensus peptide
NVEVDAAPTVDLNQVLNET

SEQ ID NO: 1447 - protein, 19 aa, Artificial
  Consensus peptide
NVEVDAAPTVDLNRVLNET

SEQ ID NO: 1448 - protein, 19 aa, Artificial
  Consensus peptide
NVEVDTAPTVDLNQVLNET

SEQ ID NO: 1449 - protein, 19 aa, Artificial
  Consensus peptide
NVEVDTAPTVDLNRVLNET

SEQ ID NO: 1450 - protein, 19 aa, Artificial
  Consensus peptide
VEVDAAPTVDLNQVLNETR

SEQ ID NO: 1451 - protein, 19 aa, Artificial
  Consensus peptide
VEVDAAPTVDLNRVLNETR

SEQ ID NO: 1452 - protein, 19 aa, Artificial
  Consensus peptide
VEVDTAPTVDLNQVLNETR

SEQ ID NO: 1453 - protein, 19 aa, Artificial
  Consensus peptide
VEVDTAPTVDLNRVLNETR

SEQ ID NO: 1454 - protein, 19 aa, Artificial
  Consensus peptide
EVDAAPTVDLNQVLNETRS

SEQ ID NO: 1455 - protein, 19 aa, Artificial
  Consensus peptide
EVDAAPTVDLNQVLNETRN

SEQ ID NO: 1456 - protein, 19 aa, Artificial
  Consensus peptide
EVDAAPTVDLNRVLNETRS

SEQ ID NO: 1457 - protein, 19 aa, Artificial
  Consensus peptide
EVDAAPTVDLNRVLNETRN

SEQ ID NO: 1458 - protein, 19 aa, Artificial
  Consensus peptide
EVDTAPTVDLNQVLNETRS

SEQ ID NO: 1459 - protein, 19 aa, Artificial
  Consensus peptide
EVDTAPTVDLNQVLNETRN

SEQ ID NO: 1460 - protein, 19 aa, Artificial
  Consensus peptide
EVDTAPTVDLNRVLNETRS

SEQ ID NO: 1461 - protein, 19 aa, Artificial
  Consensus peptide
EVDTAPTVDLNRVLNETRN

SEQ ID NO: 1462 - protein, 19 aa, Artificial
  Consensus peptide
VDAAPTVDLNQVLNETRSQ

SEQ ID NO: 1463 - protein, 19 aa, Artificial
  Consensus peptide
VDAAPTVDLNQVLNETRNQ

SEQ ID NO: 1464 - protein, 19 aa, Artificial
  Consensus peptide
VDAAPTVDLNRVLNETRSQ

SEQ ID NO: 1465 - protein, 19 aa, Artificial
  Consensus peptide
VDAAPTVDLNRVLNETRNQ

SEQ ID NO: 1466 - protein, 19 aa, Artificial
  Consensus peptide
VDTAPTVDLNQVLNETRSQ

SEQ ID NO: 1467 - protein, 19 aa, Artificial
  Consensus peptide
VDTAPTVDLNQVLNETRNQ

SEQ ID NO: 1468 - protein, 19 aa, Artificial
  Consensus peptide
VDTAPTVDLNRVLNETRSQ

SEQ ID NO: 1469 - protein, 19 aa, Artificial
  Consensus peptide
VDTAPTVDLNRVLNETRNQ

SEQ ID NO: 1470 - protein, 19 aa, Artificial
  Consensus peptide
DAAPTVDLNQVLNETRSQY

SEQ ID NO: 1471 - protein, 19 aa, Artificial
  Consensus peptide
DAAPTVDLNQVLNETRNQY

SEQ ID NO: 1472 - protein, 19 aa, Artificial
  Consensus peptide
DAAPTVDLNRVLNETRSQY

SEQ ID NO: 1473 - protein, 19 aa, Artificial
  Consensus peptide
DAAPTVDLNRVLNETRNQY

SEQ ID NO: 1474 - protein, 19 aa, Artificial
  Consensus peptide
DTAPTVDLNQVLNETRSQY

SEQ ID NO: 1475 - protein, 19 aa, Artificial
  Consensus peptide
DTAPTVDLNQVLNETRNQY

SEQ ID NO: 1476 - protein, 19 aa, Artificial
  Consensus peptide
DTAPTVDLNRVLNETRSQY

SEQ ID NO: 1477 - protein, 19 aa, Artificial
  Consensus peptide
DTAPTVDLNRVLNETRNQY

SEQ ID NO: 1478 - protein, 19 aa, Artificial
  Consensus peptide
AAPTVDLNQVLNETRSQYE

SEQ ID NO: 1479 - protein, 19 aa, Artificial
  Consensus peptide
AAPTVDLNQVLNETRNQYE

SEQ ID NO: 1480 - protein, 19 aa, Artificial
  Consensus peptide
AAPTVDLNRVLNETRSQYE

SEQ ID NO: 1481 - protein, 19 aa, Artificial
  Consensus peptide
AAPTVDLNRVLNETRNQYE

SEQ ID NO: 1482 - protein, 19 aa, Artificial
  Consensus peptide
TAPTVDLNQVLNETRSQYE

SEQ ID NO: 1483 - protein, 19 aa, Artificial
  Consensus peptide
TAPTVDLNQVLNETRNQYE

SEQ ID NO: 1484 - protein, 19 aa, Artificial
  Consensus peptide
TAPTVDLNRVLNETRSQYE

SEQ ID NO: 1485 - protein, 19 aa, Artificial
  Consensus peptide
TAPTVDLNRVLNETRNQYE

SEQ ID NO: 1486 - protein, 19 aa, Artificial
  Consensus peptide
APTVDLNQVLNETRSQYEA

SEQ ID NO: 1487 - protein, 19 aa, Artificial
  Consensus peptide
APTVDLNQVLNETRNQYEA

SEQ ID NO: 1488 - protein, 19 aa, Artificial
  Consensus peptide
APTVDLNRVLNETRSQYEA

SEQ ID NO: 1489 - protein, 19 aa, Artificial
  Consensus peptide
APTVDLNRVLNETRNQYEA

SEQ ID NO: 1490 - protein, 19 aa, Artificial
  Consensus peptide
PTVDLNQVLNETRSQYEAL

SEQ ID NO: 1491 - protein, 19 aa, Artificial
  Consensus peptide
PTVDLNQVLNETRNQYEAL

SEQ ID NO: 1492 - protein, 19 aa, Artificial
  Consensus peptide
PTVDLNRVLNETRSQYEAL

SEQ ID NO: 1493 - protein, 19 aa, Artificial
  Consensus peptide
PTVDLNRVLNETRNQYEAL

SEQ ID NO: 1494 - protein, 20 aa, Artificial
  Consensus peptide
EVNTLRCQLGDRLNVEVDAA

SEQ ID NO: 1495 - protein, 20 aa, Artificial
  Consensus peptide
EVNTLRCQLGDRLNVEVDTA

SEQ ID NO: 1496 - protein, 20 aa, Artificial
  Consensus peptide
EVNTLRCPLGDRLNVEVDAA

SEQ ID NO: 1497 - protein, 20 aa, Artificial
  Consensus peptide
EVNTLRCPLGDRLNVEVDTA

SEQ ID NO: 1498 - protein, 20 aa, Artificial
  Consensus peptide
EVNTLRSQLGDRLNVEVDAA

SEQ ID NO: 1499 - protein, 20 aa, Artificial
  Consensus peptide
EVNTLRSQLGDRLNVEVDTA

SEQ ID NO: 1500 - protein, 20 aa, Artificial
  Consensus peptide
EVNTLRSPLGDRLNVEVDAA

SEQ ID NO: 1501 - protein, 20 aa, Artificial
  Consensus peptide
EVNTLRSPLGDRLNVEVDTA

SEQ ID NO: 1502 - protein, 20 aa, Artificial
  Consensus peptide
VNTLRCQLGDRLNVEVDAAP

SEQ ID NO: 1503 - protein, 20 aa, Artificial
  Consensus peptide
VNTLRCQLGDRLNVEVDTAP

SEQ ID NO: 1504 - protein, 20 aa, Artificial
  Consensus peptide
VNTLRCPLGDRLNVEVDAAP

SEQ ID NO: 1505 - protein, 20 aa, Artificial
  Consensus peptide
VNTLRCPLGDRLNVEVDTAP

SEQ ID NO: 1506 - protein, 20 aa, Artificial
  Consensus peptide
VNTLRSQLGDRLNVEVDAAP

SEQ ID NO: 1507 - protein, 20 aa, Artificial
  Consensus peptide
VNTLRSQLGDRLNVEVDTAP

SEQ ID NO: 1508 - protein, 20 aa, Artificial
  Consensus peptide
VNTLRSPLGDRLNVEVDAAP

SEQ ID NO: 1509 - protein, 20 aa, Artificial
  Consensus peptide
VNTLRSPLGDRLNVEVDTAP

SEQ ID NO: 1510 - protein, 20 aa, Artificial
  Consensus peptide
NTLRCQLGDRLNVEVDAAPT

SEQ ID NO: 1511 - protein, 20 aa, Artificial
  Consensus peptide
NTLRCQLGDRLNVEVDTAPT

SEQ ID NO: 1512 - protein, 20 aa, Artificial
  Consensus peptide
NTLRCPLGDRLNVEVDAAPT

SEQ ID NO: 1513 - protein, 20 aa, Artificial
  Consensus peptide
NTLRCPLGDRLNVEVDTAPT

SEQ ID NO: 1514 - protein, 20 aa, Artificial
  Consensus peptide
NTLRSQLGDRLNVEVDAAPT

SEQ ID NO: 1515 - protein, 20 aa, Artificial
  Consensus peptide
NTLRSQLGDRLNVEVDTAPT

SEQ ID NO: 1516 - protein, 20 aa, Artificial
  Consensus peptide
NTLRSPLGDRLNVEVDAAPT

SEQ ID NO: 1517 - protein, 20 aa, Artificial
  Consensus peptide
NTLRSPLGDRLNVEVDTAPT

SEQ ID NO: 1518 - protein, 20 aa, Artificial
  Consensus peptide
TLRCQLGDRLNVEVDAAPTV

SEQ ID NO: 1519 - protein, 20 aa, Artificial
  Consensus peptide
TLRCQLGDRLNVEVDTAPTV

SEQ ID NO: 1520 - protein, 20 aa, Artificial
  Consensus peptide
TLRCPLGDRLNVEVDAAPTV

SEQ ID NO: 1521 - protein, 20 aa, Artificial
  Consensus peptide
TLRCPLGDRLNVEVDTAPTV

SEQ ID NO: 1522 - protein, 20 aa, Artificial
  Consensus peptide
TLRSQLGDRLNVEVDAAPTV

SEQ ID NO: 1523 - protein, 20 aa, Artificial
  Consensus peptide
TLRSQLGDRLNVEVDTAPTV

SEQ ID NO: 1524 - protein, 20 aa, Artificial
  Consensus peptide
TLRSPLGDRLNVEVDAAPTV

SEQ ID NO: 1525 - protein, 20 aa, Artificial
  Consensus peptide
TLRSPLGDRLNVEVDTAPTV

SEQ ID NO: 1526 - protein, 20 aa, Artificial
  Consensus peptide
LRCQLGDRLNVEVDAAPTVD

SEQ ID NO: 1527 - protein, 20 aa, Artificial
  Consensus peptide
LRCQLGDRLNVEVDTAPTVD

SEQ ID NO: 1528 - protein, 20 aa, Artificial
  Consensus peptide
LRCPLGDRLNVEVDAAPTVD

SEQ ID NO: 1529 - protein, 20 aa, Artificial
  Consensus peptide
LRCPLGDRLNVEVDTAPTVD

SEQ ID NO: 1530 - protein, 20 aa, Artificial
  Consensus peptide
LRSQLGDRLNVEVDAAPTVD

SEQ ID NO: 1531 - protein, 20 aa, Artificial
  Consensus peptide
LRSQLGDRLNVEVDTAPTVD

SEQ ID NO: 1532 - protein, 20 aa, Artificial
  Consensus peptide
LRSPLGDRLNVEVDAAPTVD

SEQ ID NO: 1533 - protein, 20 aa, Artificial
  Consensus peptide
LRSPLGDRLNVEVDTAPTVD

SEQ ID NO: 1534 - protein, 20 aa, Artificial
  Consensus peptide
RCQLGDRLNVEVDAAPTVDL

SEQ ID NO: 1535 - protein, 20 aa, Artificial
  Consensus peptide
RCQLGDRLNVEVDTAPTVDL

SEQ ID NO: 1536 - protein, 20 aa, Artificial
  Consensus peptide
RCPLGDRLNVEVDAAPTVDL

SEQ ID NO: 1537 - protein, 20 aa, Artificial
  Consensus peptide
RCPLGDRLNVEVDTAPTVDL

SEQ ID NO: 1538 - protein, 20 aa, Artificial
  Consensus peptide
RSQLGDRLNVEVDAAPTVDL

SEQ ID NO: 1539 - protein, 20 aa, Artificial
  Consensus peptide
RSQLGDRLNVEVDTAPTVDL

SEQ ID NO: 1540 - protein, 20 aa, Artificial
  Consensus peptide
RSPLGDRLNVEVDAAPTVDL

SEQ ID NO: 1541 - protein, 20 aa, Artificial
  Consensus peptide
RSPLGDRLNVEVDTAPTVDL

SEQ ID NO: 1542 - protein, 20 aa, Artificial
  Consensus peptide
CQLGDRLNVEVDAAPTVDLN

SEQ ID NO: 1543 - protein, 20 aa, Artificial
  Consensus peptide
CQLGDRLNVEVDTAPTVDLN

SEQ ID NO: 1544 - protein, 20 aa, Artificial
  Consensus peptide
CPLGDRLNVEVDAAPTVDLN

SEQ ID NO: 1545 - protein, 20 aa, Artificial
  Consensus peptide
CPLGDRLNVEVDTAPTVDLN

SEQ ID NO: 1546 - protein, 20 aa, Artificial
  Consensus peptide
SQLGDRLNVEVDAAPTVDLN

SEQ ID NO: 1547 - protein, 20 aa, Artificial
  Consensus peptide
SQLGDRLNVEVDTAPTVDLN

SEQ ID NO: 1548 - protein, 20 aa, Artificial
  Consensus peptide
SPLGDRLNVEVDAAPTVDLN

SEQ ID NO: 1549 - protein, 20 aa, Artificial
  Consensus peptide
SPLGDRLNVEVDTAPTVDLN

SEQ ID NO: 1550 - protein, 20 aa, Artificial
  Consensus peptide
QLGDRLNVEVDAAPTVDLNQ

SEQ ID NO: 1551 - protein, 20 aa, Artificial
  Consensus peptide
QLGDRLNVEVDAAPTVDLNR

SEQ ID NO: 1552 - protein, 20 aa, Artificial
  Consensus peptide
QLGDRLNVEVDTAPTVDLNQ

SEQ ID NO: 1553 - protein, 20 aa, Artificial
  Consensus peptide
QLGDRLNVEVDTAPTVDLNR

SEQ ID NO: 1554 - protein, 20 aa, Artificial
  Consensus peptide
PLGDRLNVEVDAAPTVDLNQ

SEQ ID NO: 1555 - protein, 20 aa, Artificial
  Consensus peptide
PLGDRLNVEVDAAPTVDLNR

SEQ ID NO: 1556 - protein, 20 aa, Artificial
  Consensus peptide
PLGDRLNVEVDTAPTVDLNQ

SEQ ID NO: 1557 - protein, 20 aa, Artificial
  Consensus peptide
PLGDRLNVEVDTAPTVDLNR

SEQ ID NO: 1558 - protein, 20 aa, Artificial
  Consensus peptide
LGDRLNVEVDAAPTVDLNQV

SEQ ID NO: 1559 - protein, 20 aa, Artificial
  Consensus peptide
LGDRLNVEVDAAPTVDLNRV

SEQ ID NO: 1560 - protein, 20 aa, Artificial
  Consensus peptide
LGDRLNVEVDTAPTVDLNQV

SEQ ID NO: 1561 - protein, 20 aa, Artificial
  Consensus peptide
LGDRLNVEVDTAPTVDLNRV

SEQ ID NO: 1562 - protein, 20 aa, Artificial
  Consensus peptide
GDRLNVEVDAAPTVDLNQVL

SEQ ID NO: 1563 - protein, 20 aa, Artificial
  Consensus peptide
GDRLNVEVDAAPTVDLNRVL

SEQ ID NO: 1564 - protein, 20 aa, Artificial
  Consensus peptide
GDRLNVEVDTAPTVDLNQVL

SEQ ID NO: 1565 - protein, 20 aa, Artificial
  Consensus peptide
GDRLNVEVDTAPTVDLNRVL

SEQ ID NO: 1566 - protein, 20 aa, Artificial
  Consensus peptide
DRLNVEVDAAPTVDLNQVLN

SEQ ID NO: 1567 - protein, 20 aa, Artificial
  Consensus peptide
DRLNVEVDAAPTVDLNRVLN

SEQ ID NO: 1568 - protein, 20 aa, Artificial
  Consensus peptide
DRLNVEVDTAPTVDLNQVLN

SEQ ID NO: 1569 - protein, 20 aa, Artificial
  Consensus peptide
DRLNVEVDTAPTVDLNRVLN

SEQ ID NO: 1570 - protein, 20 aa, Artificial
  Consensus peptide
RLNVEVDAAPTVDLNQVLNE

SEQ ID NO: 1571 - protein, 20 aa, Artificial
  Consensus peptide
RLNVEVDAAPTVDLNRVLNE

SEQ ID NO: 1572 - protein, 20 aa, Artificial
  Consensus peptide
RLNVEVDTAPTVDLNQVLNE

SEQ ID NO: 1573 - protein, 20 aa, Artificial
  Consensus peptide
RLNVEVDTAPTVDLNRVLNE

SEQ ID NO: 1574 - protein, 20 aa, Artificial
  Consensus peptide
LNVEVDAAPTVDLNQVLNET

SEQ ID NO: 1575 - protein, 20 aa, Artificial
  Consensus peptide
LNVEVDAAPTVDLNRVLNET

SEQ ID NO: 1576 - protein, 20 aa, Artificial
  Consensus peptide
LNVEVDTAPTVDLNQVLNET

SEQ ID NO: 1577 - protein, 20 aa, Artificial
  Consensus peptide
LNVEVDTAPTVDLNRVLNET

SEQ ID NO: 1578 - protein, 20 aa, Artificial
  Consensus peptide
NVEVDAAPTVDLNQVLNETR

SEQ ID NO: 1579 - protein, 20 aa, Artificial
  Consensus peptide
NVEVDAAPTVDLNRVLNETR

SEQ ID NO: 1580 - protein, 20 aa, Artificial
  Consensus peptide
NVEVDTAPTVDLNQVLNETR

SEQ ID NO: 1581 - protein, 20 aa, Artificial
  Consensus peptide
NVEVDTAPTVDLNRVLNETR

SEQ ID NO: 1582 - protein, 20 aa, Artificial
  Consensus peptide
VEVDAAPTVDLNQVLNETRS

SEQ ID NO: 1583 - protein, 20 aa, Artificial
  Consensus peptide
VEVDAAPTVDLNQVLNETRN

SEQ ID NO: 1584 - protein, 20 aa, Artificial
  Consensus peptide
VEVDAAPTVDLNRVLNETRS

SEQ ID NO: 1585 - protein, 20 aa, Artificial
  Consensus peptide
VEVDAAPTVDLNRVLNETRN

SEQ ID NO: 1586 - protein, 20 aa, Artificial
  Consensus peptide
VEVDTAPTVDLNQVLNETRS

SEQ ID NO: 1587 - protein, 20 aa, Artificial
  Consensus peptide
VEVDTAPTVDLNQVLNETRN

SEQ ID NO: 1588 - protein, 20 aa, Artificial
  Consensus peptide
VEVDTAPTVDLNRVLNETRS

SEQ ID NO: 1589 - protein, 20 aa, Artificial
  Consensus peptide
VEVDTAPTVDLNRVLNETRN

SEQ ID NO: 1590 - protein, 20 aa, Artificial
  Consensus peptide
EVDAAPTVDLNQVLNETRSQ

SEQ ID NO: 1591 - protein, 20 aa, Artificial
  Consensus peptide
EVDAAPTVDLNQVLNETRNQ

SEQ ID NO: 1592 - protein, 20 aa, Artificial
  Consensus peptide
EVDAAPTVDLNRVLNETRSQ

SEQ ID NO: 1593 - protein, 20 aa, Artificial
  Consensus peptide
EVDAAPTVDLNRVLNETRNQ

SEQ ID NO: 1594 - protein, 20 aa, Artificial
  Consensus peptide
EVDTAPTVDLNQVLNETRSQ

SEQ ID NO: 1595 - protein, 20 aa, Artificial
  Consensus peptide
EVDTAPTVDLNQVLNETRNQ

SEQ ID NO: 1596 - protein, 20 aa, Artificial
  Consensus peptide
EVDTAPTVDLNRVLNETRSQ

SEQ ID NO: 1597 - protein, 20 aa, Artificial
  Consensus peptide
EVDTAPTVDLNRVLNETRNQ

SEQ ID NO: 1598 - protein, 20 aa, Artificial
  Consensus peptide
VDAAPTVDLNQVLNETRSQY

SEQ ID NO: 1599 - protein, 20 aa, Artificial
  Consensus peptide
VDAAPTVDLNQVLNETRNQY

SEQ ID NO: 1600 - protein, 20 aa, Artificial
  Consensus peptide
VDAAPTVDLNRVLNETRSQY

SEQ ID NO: 1601 - protein, 20 aa, Artificial
  Consensus peptide
VDAAPTVDLNRVLNETRNQY

SEQ ID NO: 1602 - protein, 20 aa, Artificial
  Consensus peptide
VDTAPTVDLNQVLNETRSQY

SEQ ID NO: 1603 - protein, 20 aa, Artificial
  Consensus peptide
VDTAPTVDLNQVLNETRNQY

SEQ ID NO: 1604 - protein, 20 aa, Artificial
  Consensus peptide
VDTAPTVDLNRVLNETRSQY

SEQ ID NO: 1605 - protein, 20 aa, Artificial
  Consensus peptide
VDTAPTVDLNRVLNETRSQY

SEQ ID NO: 1606 - protein, 20 aa, Artificial
  Consensus peptide
DAAPTVDLNQVLNETRSQYE

SEQ ID NO: 1607 - protein, 20 aa, Artificial
  Consensus peptide
DAAPTVDLNQVLNETRNQYE

SEQ ID NO: 1608 - protein, 20 aa, Artificial
  Consensus peptide
DAAPTVDLNRVLNETRSQYE

SEQ ID NO: 1609 - protein, 20 aa, Artificial
  Consensus peptide
DAAPTVDLNRVLNETRNQYE

SEQ ID NO: 1610 - protein, 20 aa, Artificial
  Consensus peptide
DTAPTVDLNQVLNETRSQYE

SEQ ID NO: 1611 - protein, 20 aa, Artificial
  Consensus peptide
DTAPTVDLNQVLNETRNQYE

SEQ ID NO: 1612 - protein, 20 aa, Artificial
  Consensus peptide
DTAPTVDLNRVLNETRSQYE

SEQ ID NO: 1613 - protein, 20 aa, Artificial
  Consensus peptide
DTAPTVDLNRVLNETRNQYE

SEQ ID NO: 1614 - protein, 20 aa, Artificial
  Consensus peptide
AAPTVDLNQVLNETRSQYEA

SEQ ID NO: 1615 - protein, 20 aa, Artificial
  Consensus peptide
AAPTVDLNQVLNETRNQYEA

SEQ ID NO: 1616 - protein, 20 aa, Artificial
  Consensus peptide
AAPTVDLNRVLNETRSQYEA

SEQ ID NO: 1617 - protein, 20 aa, Artificial
  Consensus peptide
AAPTVDLNRVLNETRNQYEA

SEQ ID NO: 1618 - protein, 20 aa, Artificial
  Consensus peptide
TAPTVDLNQVLNETRSQYEA

SEQ ID NO: 1619 - protein, 20 aa, Artificial
  Consensus peptide
TAPTVDLNQVLNETRNQYEA

SEQ ID NO: 1620 - protein, 20 aa, Artificial
  Consensus peptide
TAPTVDLNRVLNETRSQYEA

SEQ ID NO: 1621 - protein, 20 aa, Artificial
  Consensus peptide
TAPTVDLNRVLNETRNQYEA

SEQ ID NO: 1622 - protein, 20 aa, Artificial
  Consensus peptide
APTVDLNQVLNETRSQYEAL

SEQ ID NO: 1623 - protein, 20 aa, Artificial
  Consensus peptide
APTVDLNQVLNETRNQYEAL

SEQ ID NO: 1624 - protein, 20 aa, Artificial
  Consensus peptide
APTVDLNRVLNETRSQYEAL

SEQ ID NO: 1625 - protein, 20 aa, Artificial
  Consensus peptide
APTVDLNRVLNETRNQYEAL

SEQ ID NO: 1626 - protein, 21 aa, Artificial
  Consensus peptide
EVNTLRCQLGDRLNVEVDAAP

SEQ ID NO: 1627 - protein, 21 aa, Artificial
  Consensus peptide
EVNTLRCQLGDRLNVEVDTAP

SEQ ID NO: 1628 - protein, 21 aa, Artificial
  Consensus peptide
EVNTLRCPLGDRLNVEVDAAP

SEQ ID NO: 1629 - protein, 21 aa, Artificial
  Consensus peptide
EVNTLRCPLGDRLNVEVDTAP

SEQ ID NO: 1630 - protein, 21 aa, Artificial
  Consensus peptide
EVNTLRSQLGDRLNVEVDAAP

SEQ ID NO: 1631 - protein, 21 aa, Artificial
  Consensus peptide
EVNTLRSQLGDRLNVEVDTAP

SEQ ID NO: 1632 - protein, 21 aa, Artificial
  Consensus peptide
EVNTLRSPLGDRLNVEVDAAP

SEQ ID NO: 1633 - protein, 21 aa, Artificial
  Consensus peptide
EVNTLRSPLGDRLNVEVDTAP

SEQ ID NO: 1634 - protein, 21 aa, Artificial
  Consensus peptide
VNTLRCQLGDRLNVEVDAAPT

SEQ ID NO: 1635 - protein, 21 aa, Artificial
  Consensus peptide
VNTLRCQLGDRLNVEVDTAPT

SEQ ID NO: 1636 - protein, 21 aa, Artificial
  Consensus peptide
VNTLRCPLGDRLNVEVDAAPT

SEQ ID NO: 1637 - protein, 21 aa, Artificial
  Consensus peptide
VNTLRCPLGDRLNVEVDTAPT

SEQ ID NO: 1638 - protein, 21 aa, Artificial
  Consensus peptide
VNTLRSQLGDRLNVEVDAAPT

SEQ ID NO: 1639 - protein, 21 aa, Artificial
  Consensus peptide
VNTLRSQLGDRLNVEVDTAPT

SEQ ID NO: 1640 - protein, 21 aa, Artificial
  Consensus peptide
VNTLRSPLGDRLNVEVDAAPT

SEQ ID NO: 1641 - protein, 21 aa, Artificial
  Consensus peptide
VNTLRSPLGDRLNVEVDTAPT

SEQ ID NO: 1642 - protein, 21 aa, Artificial
  Consensus peptide
NTLRCQLGDRLNVEVDAAPTV

SEQ ID NO: 1643 - protein, 21 aa, Artificial
  Consensus peptide
NTLRCQLGDRLNVEVDTAPTV

SEQ ID NO: 1644 - protein, 21 aa, Artificial
  Consensus peptide
NTLRCPLGDRLNVEVDAAPTV

SEQ ID NO: 1645 - protein, 21 aa, Artificial
  Consensus peptide
NTLRCPLGDRLNVEVDTAPTV

SEQ ID NO: 1646 - protein, 21 aa, Artificial
  Consensus peptide
NTLRSQLGDRLNVEVDAAPTV

SEQ ID NO: 1647 - protein, 21 aa, Artificial
  Consensus peptide
NTLRSQLGDRLNVEVDTAPTV

SEQ ID NO: 1648 - protein, 21 aa, Artificial
  Consensus peptide
NTLRSPLGDRLNVEVDAAPTV

SEQ ID NO: 1649 - protein, 21 aa, Artificial
  Consensus peptide
NTLRSPLGDRLNVEVDTAPTV

SEQ ID NO: 1650 - protein, 21 aa, Artificial
  Consensus peptide
TLRCQLGDRLNVEVDAAPTVD

SEQ ID NO: 1651 - protein, 21 aa, Artificial
  Consensus peptide
TLRCQLGDRLNVEVDTAPTVD

SEQ ID NO: 1652 - protein, 21 aa, Artificial
  Consensus peptide
TLRCPLGDRLNVEVDAAPTVD

SEQ ID NO: 1653 - protein, 21 aa, Artificial
  Consensus peptide
TLRCPLGDRLNVEVDTAPTVD

SEQ ID NO: 1654 - protein, 21 aa, Artificial
  Consensus peptide
TLRSQLGDRLNVEVDAAPTVD

SEQ ID NO: 1655 - protein, 21 aa, Artificial
  Consensus peptide
TLRSQLGDRLNVEVDTAPTVD

SEQ ID NO: 1656 - protein, 21 aa, Artificial
  Consensus peptide
TLRSPLGDRLNVEVDAAPTVD

SEQ ID NO: 1657 - protein, 21 aa, Artificial
  Consensus peptide
TLRSPLGDRLNVEVDTAPTVD

SEQ ID NO: 1658 - protein, 21 aa, Artificial
  Consensus peptide
LRCQLGDRLNVEVDAAPTVDL

SEQ ID NO: 1659 - protein, 21 aa, Artificial
  Consensus peptide
LRCQLGDRLNVEVDTAPTVDL

SEQ ID NO: 1660 - protein, 21 aa, Artificial
  Consensus peptide
LRCPLGDRLNVEVDAAPTVDL

SEQ ID NO: 1661 - protein, 21 aa, Artificial
  Consensus peptide
LRCPLGDRLNVEVDTAPTVDL

SEQ ID NO: 1662 - protein, 21 aa, Artificial
  Consensus peptide
LRSQLGDRLNVEVDAAPTVDL

SEQ ID NO: 1663 - protein, 21 aa, Artificial
  Consensus peptide
LRSQLGDRLNVEVDTAPTVDL

SEQ ID NO: 1664 - protein, 21 aa, Artificial
  Consensus peptide
LRCPLGDRLNVEVDAAPTVDL

SEQ ID NO: 1665 - protein, 21 aa, Artificial
  Consensus peptide
LRSPLGDRLNVEVDTAPTVDL

SEQ ID NO: 1666 - protein, 21 aa, Artificial
  Consensus peptide
RCQLGDRLNVEVDAAPTVDLN

SEQ ID NO: 1667 - protein, 21 aa, Artificial
  Consensus peptide
RCQLGDRLNVEVDTAPTVDLN

SEQ ID NO: 1668 - protein, 21 aa, Artificial
  Consensus peptide
RCPLGDRLNVEVDAAPTVDLN

SEQ ID NO: 1669 - protein, 21 aa, Artificial
  Consensus peptide
RCPLGDRLNVEVDTAPTVDLN

SEQ ID NO: 1670 - protein, 21 aa, Artificial
  Consensus peptide
RSQLGDRLNVEVDAAPTVDLN

SEQ ID NO: 1671 - protein, 21 aa, Artificial
  Consensus peptide
RSQLGDRLNVEVDTAPTVDLN

SEQ ID NO: 1672 - protein, 21 aa, Artificial
  Consensus peptide
RSPLGDRLNVEVDAAPTVDLN

SEQ ID NO: 1673 - protein, 21 aa, Artificial
  Consensus peptide
RSPLGDRLNVEVDTAPTVDLN

SEQ ID NO: 1674 - protein, 21 aa, Artificial
  Consensus peptide
CQLGDRLNVEVDAAPTVDLNQ

SEQ ID NO: 1675 - protein, 21 aa, Artificial
  Consensus peptide
SQLGDRLNVEVDAAPTVDLNQ

SEQ ID NO: 1676 - protein, 21 aa, Artificial
  Consensus peptide
CPLGDRLNVEVDAAPTVDLNQ

SEQ ID NO: 1677 - protein, 21 aa, Artificial
  Consensus peptide
SPLGDRLNVEVDAAPTVDLNQ

SEQ ID NO: 1678 - protein, 21 aa, Artificial
  Consensus peptide
CQLGDRLNVEVDTAPTVDLNQ

SEQ ID NO: 1679 - protein, 21 aa, Artificial
  Consensus peptide
SQLGDRLNVEVDTAPTVDLNQ

SEQ ID NO: 1680 - protein, 21 aa, Artificial
  Consensus peptide
CPLGDRLNVEVDTAPTVDLNQ

SEQ ID NO: 1681 - protein, 21 aa, Artificial
  Consensus peptide
SPLGDRLNVEVDTAPTVDLNQ

SEQ ID NO: 1682 - protein, 21 aa, Artificial
  Consensus peptide
CQLGDRLNVEVDAAPTVDLNR

SEQ ID NO: 1683 - protein, 21 aa, Artificial
  Consensus peptide
SQLGDRLNVEVDAAPTVDLNR

SEQ ID NO: 1684 - protein, 21 aa, Artificial
  Consensus peptide
CPLGDRLNVEVDAAPTVDLNR

SEQ ID NO: 1685 - protein, 21 aa, Artificial
  Consensus peptide
SPLGDRLNVEVDAAPTVDLNR

SEQ ID NO: 1686 - protein, 21 aa, Artificial
  Consensus peptide
CQLGDRLNVEVDTAPTVDLNR

SEQ ID NO: 1687 - protein, 21 aa, Artificial
  Consensus peptide
SQLGDRLNVEVDTAPTVDLNR

SEQ ID NO: 1688 - protein, 21 aa, Artificial
  Consensus peptide
CPLGDRLNVEVDTAPTVDLNR

SEQ ID NO: 1689 - protein, 21 aa, Artificial
  Consensus peptide
SPLGDRLNVEVDTAPTVDLNR

SEQ ID NO: 1690 - protein, 21 aa, Artificial
  Consensus peptide
QLGDRLNVEVDAAPTVDLNQV

SEQ ID NO: 1691 - protein, 21 aa, Artificial
  Consensus peptide
QLGDRLNVEVDAAPTVDLNRV

SEQ ID NO: 1692 - protein, 21 aa, Artificial
  Consensus peptide
QLGDRLNVEVDTAPTVDLNQV

SEQ ID NO: 1693 - protein, 21 aa, Artificial
  Consensus peptide
QLGDRLNVEVDTAPTVDLNRV

SEQ ID NO: 1694 - protein, 21 aa, Artificial
  Consensus peptide
PLGDRLNVEVDAAPTVDLNQV

SEQ ID NO: 1695 - protein, 21 aa, Artificial
  Consensus peptide
PLGDRLNVEVDAAPTVDLNRV

SEQ ID NO: 1696 - protein, 21 aa, Artificial
  Consensus peptide
PLGDRLNVEVDTAPTVDLNQV

SEQ ID NO: 1697 - protein, 21 aa, Artificial
  Consensus peptide
PLGDRLNVEVDTAPTVDLNRV

SEQ ID NO: 1698 - protein, 21 aa, Artificial
  Consensus peptide
LGDRLNVEVDAAPTVDLNQVL

SEQ ID NO: 1699 - protein, 21 aa, Artificial
  Consensus peptide
LGDRLNVEVDAAPTVDLNRVL

SEQ ID NO: 1700 - protein, 21 aa, Artificial
  Consensus peptide
LGDRLNVEVDTAPTVDLNQVL

SEQ ID NO: 1701 - protein, 21 aa, Artificial
  Consensus peptide
LGDRLNVEVDTAPTVDLNRVL

SEQ ID NO: 1702 - protein, 21 aa, Artificial
  Consensus peptide
GDRLNVEVDAAPTVDLNQVLN

SEQ ID NO: 1703 - protein, 21 aa, Artificial
  Consensus peptide
GDRLNVEVDAAPTVDLNRVLN

SEQ ID NO: 1704 - protein, 21 aa, Artificial
  Consensus peptide
GDRLNVEVDTAPTVDLNQVLN

SEQ ID NO: 1705 - protein, 21 aa, Artificial
  Consensus peptide
GDRLNVEVDTAPTVDLNRVLN

SEQ ID NO: 1706 - protein, 21 aa, Artificial
  Consensus peptide
DRLNVEVDAAPTVDLNQVLNE

SEQ ID NO: 1707 - protein, 21 aa, Artificial
  Consensus peptide
DRLNVEVDAAPTVDLNRVLNE

SEQ ID NO: 1708 - protein, 21 aa, Artificial
  Consensus peptide
DRLNVEVDTAPTVDLNQVLNE

SEQ ID NO: 1709 - protein, 21 aa, Artificial
  Consensus peptide
DRLNVEVDTAPTVDLNRVLNE

SEQ ID NO: 1710 - protein, 21 aa, Artificial
  Consensus peptide
RLNVEVDAAPTVDLNQVLNET

SEQ ID NO: 1711 - protein, 21 aa, Artificial
  Consensus peptide
RLNVEVDAAPTVDLNRVLNET

SEQ ID NO: 1712 - protein, 21 aa, Artificial
  Consensus peptide
RLNVEVDTAPTVDLNQVLNET

SEQ ID NO: 1713 - protein, 21 aa, Artificial
  Consensus peptide
RLNVEVDTAPTVDLNRVLNET

SEQ ID NO: 1714 - protein, 21 aa, Artificial
  Consensus peptide
LNVEVDAAPTVDLNQVLNETR

SEQ ID NO: 1715 - protein, 21 aa, Artificial
  Consensus peptide
LNVEVDAAPTVDLNRVLNETR

SEQ ID NO: 1716 - protein, 21 aa, Artificial
  Consensus peptide
LNVEVDTAPTVDLNQVLNETR

SEQ ID NO: 1717 - protein, 21 aa, Artificial
  Consensus peptide
LNVEVDTAPTVDLNRVLNETR

SEQ ID NO: 1718 - protein, 21 aa, Artificial
  Consensus peptide
NVEVDAAPTVDLNQVLNETRS

SEQ ID NO: 1719 - protein, 21 aa, Artificial
  Consensus peptide
NVEVDAAPTVDLNQVLNETRN

SEQ ID NO: 1720 - protein, 21 aa, Artificial
  Consensus peptide
NVEVDAAPTVDLNRVLNETRS

SEQ ID NO: 1721 - protein, 21 aa, Artificial
  Consensus peptide
NVEVDAAPTVDLNRVLNETRN

SEQ ID NO: 1722 - protein, 21 aa, Artificial
  Consensus peptide
NVEVDTAPTVDLNQVLNETRS

SEQ ID NO: 1723 - protein, 21 aa, Artificial
  Consensus peptide
NVEVDTAPTVDLNQVLNETRN

SEQ ID NO: 1724 - protein, 21 aa, Artificial
  Consensus peptide
NVEVDTAPTVDLNRVLNETRS

SEQ ID NO: 1725 - protein, 21 aa, Artificial
  Consensus peptide
NVEVDTAPTVDLNRVLNETRN

SEQ ID NO: 1726 - protein, 21 aa, Artificial
  Consensus peptide
VEVDAAPTVDLNQVLNETRSQ

SEQ ID NO: 1727 - protein, 21 aa, Artificial
  Consensus peptide
VEVDAAPTVDLNQVLNETRNQ

SEQ ID NO: 1728 - protein, 21 aa, Artificial
  Consensus peptide
VEVDAAPTVDLNRVLNETRSQ

SEQ ID NO: 1729 - protein, 21 aa, Artificial
  Consensus peptide
VEVDAAPTVDLNRVLNETRNQ

SEQ ID NO: 1730 - protein, 21 aa, Artificial
  Consensus peptide
VEVDTAPTVDLNQVLNETRSQ

SEQ ID NO: 1731 - protein, 21 aa, Artificial
  Consensus peptide
VEVDTAPTVDLNQVLNETRNQ

SEQ ID NO: 1732 - protein, 21 aa, Artificial
  Consensus peptide
VEVDTAPTVDLNRVLNETRSQ

SEQ ID NO: 1733 - protein, 21 aa, Artificial
  Consensus peptide
VEVDTAPTVDLNRVLNETRNQ

SEQ ID NO: 1734 - protein, 21 aa, Artificial
  Consensus peptide
EVDAAPTVDLNQVLNETRSQY

SEQ ID NO: 1735 - protein, 21 aa, Artificial
  Consensus peptide
EVDAAPTVDLNQVLNETRNQY

SEQ ID NO: 1736 - protein, 21 aa, Artificial
  Consensus peptide
EVDAAPTVDLNRVLNETRSQY

SEQ ID NO: 1737 - protein, 21 aa, Artificial
  Consensus peptide
EVDAAPTVDLNRVLNETRNQY

SEQ ID NO: 1738 - protein, 21 aa, Artificial
  Consensus peptide
EVDTAPTVDLNQVLNETRSQY

SEQ ID NO: 1739 - protein, 21 aa, Artificial
  Consensus peptide
EVDTAPTVDLNQVLNETRNQY

SEQ ID NO: 1740 - protein, 21 aa, Artificial
  Consensus peptide
EVDTAPTVDLNRVLNETRSQY

SEQ ID NO: 1741 - protein, 21 aa, Artificial
  Consensus peptide
EVDTAPTVDLNRVLNETRNQY

SEQ ID NO: 1742 - protein, 21 aa, Artificial
  Consensus peptide
VDAAPTVDLNQVLNETRSQYE

SEQ ID NO: 1743 - protein, 21 aa, Artificial
  Consensus peptide
VDAAPTVDLNQVLNETRNQYE

SEQ ID NO: 1744 - protein, 21 aa, Artificial
  Consensus peptide
VDAAPTVDLNRVLNETRSQYE

SEQ ID NO: 1745 - protein, 21 aa, Artificial
  Consensus peptide
VDAAPTVDLNRVLNETRNQYE

SEQ ID NO: 1746 - protein, 21 aa, Artificial
  Consensus peptide
VDTAPTVDLNQVLNETRSQYE

SEQ ID NO: 1747 - protein, 21 aa, Artificial
  Consensus peptide
VDTAPTVDLNQVLNETRNQYE

SEQ ID NO: 1748 - protein, 21 aa, Artificial
  Consensus peptide
VDTAPTVDLNRVLNETRSQYE

SEQ ID NO: 1749 - protein, 21 aa, Artificial
  Consensus peptide
VDTAPTVDLNRVLNETRNQYE

SEQ ID NO: 1750 - protein, 21 aa, Artificial
  Consensus peptide
DAAPTVDLNQVLNETRSQYEA

SEQ ID NO: 1751 - protein, 21 aa, Artificial
  Consensus peptide
DAAPTVDLNQVLNETRNQYEA

SEQ ID NO: 1752 - protein, 21 aa, Artificial
  Consensus peptide
DAAPTVDLNRVLNETRSQYEA

SEQ ID NO: 1753 - protein, 21 aa, Artificial
  Consensus peptide
DAAPTVDLNRVLNETRNQYEA

SEQ ID NO: 1754 - protein, 21 aa, Artificial
  Consensus peptide
DTAPTVDLNQVLNETRSQYEA

SEQ ID NO: 1755 - protein, 21 aa, Artificial
  Consensus peptide
DTAPTVDLNQVLNETRNQYEA

SEQ ID NO: 1756 - protein, 21 aa, Artificial
  Consensus peptide
DTAPTVDLNRVLNETRSQYEA

SEQ ID NO: 1757 - protein, 21 aa, Artificial
  Consensus peptide
DTAPTVDLNRVLNETRNQYEA

SEQ ID NO: 1758 - protein, 21 aa, Artificial
  Consensus peptide
AAPTVDLNQVLNETRSQYEAL

SEQ ID NO: 1759 - protein, 21 aa, Artificial
  Consensus peptide
AAPTVDLNQVLNETRNQYEAL

SEQ ID NO: 1760 - protein, 21 aa, Artificial
  Consensus peptide
AAPTVDLNRVLNETRSQYEAL

SEQ ID NO: 1761 - protein, 21 aa, Artificial
  Consensus peptide
AAPTVDLNRVLNETRNQYEAL

SEQ ID NO: 1762 - protein, 21 aa, Artificial
  Consensus peptide
TAPTVDLNQVLNETRSQYEAL

SEQ ID NO: 1763 - protein, 21 aa, Artificial
  Consensus peptide
TAPTVDLNQVLNETRNQYEAL

SEQ ID NO: 1764 - protein, 21 aa, Artificial
  Consensus peptide
TAPTVDLNRVLNETRSQYEAL

SEQ ID NO: 1765 - protein, 21 aa, Artificial
  Consensus peptide
TAPTVDLNRVLNETRNQYEAL

SEQ ID NO: 1766 - protein, 22 aa, Artificial
  Consensus peptide
EVNTLRCQLGDRLNVEVDAAPT

SEQ ID NO: 1767 - protein, 22 aa, Artificial
  Consensus peptide
EVNTLRCQLGDRLNVEVDTAPT

SEQ ID NO: 1768 - protein, 22 aa, Artificial
  Consensus peptide
EVNTLRCPLGDRLNVEVDAAPT

SEQ ID NO: 1769 - protein, 22 aa, Artificial
  Consensus peptide
EVNTLRCPLGDRLNVEVDTAPT

SEQ ID NO: 1770 - protein, 22 aa, Artificial
  Consensus peptide
EVNTLRSQLGDRLNVEVDAAPT

SEQ ID NO: 1771 - protein, 22 aa, Artificial
  Consensus peptide
EVNTLRSQLGDRLNVEVDTAPT

SEQ ID NO: 1772 - protein, 22 aa, Artificial
  Consensus peptide
EVNTLRSPLGDRLNVEVDAAPT

SEQ ID NO: 1773 - protein, 22 aa, Artificial
  Consensus peptide
EVNTLRSPLGDRLNVEVDTAPT

SEQ ID NO: 1774 - protein, 22 aa, Artificial
  Consensus peptide
VNTLRCQLGDRLNVEVDAAPTV

SEQ ID NO: 1775 - protein, 22 aa, Artificial
  Consensus peptide
VNTLRCQLGDRLNVEVDTAPTV

SEQ ID NO: 1776 - protein, 22 aa, Artificial
  Consensus peptide
VNTLRCPLGDRLNVEVDAAPTV

SEQ ID NO: 1777 - protein, 22 aa, Artificial
  Consensus peptide
VNTLRCPLGDRLNVEVDTAPTV

SEQ ID NO: 1778 - protein, 22 aa, Artificial
  Consensus peptide
VNTLRSQLGDRLNVEVDAAPTV

SEQ ID NO: 1779 - protein, 22 aa, Artificial
  Consensus peptide
VNTLRSQLGDRLNVEVDTAPTV

SEQ ID NO: 1780 - protein, 22 aa, Artificial
  Consensus peptide
VNTLRSPLGDRLNVEVDAAPTV

SEQ ID NO: 1781 - protein, 22 aa, Artificial
  Consensus peptide
VNTLRSPLGDRLNVEVDTAPTV

SEQ ID NO: 1782 - protein, 22 aa, Artificial
  Consensus peptide
NTLRCQLGDRLNVEVDAAPTVD

SEQ ID NO: 1783 - protein, 22 aa, Artificial
  Consensus peptide
NTLRCQLGDRLNVEVDTAPTVD

SEQ ID NO: 1784 - protein, 22 aa, Artificial
  Consensus peptide
NTLRCPLGDRLNVEVDAAPTVD

SEQ ID NO: 1785 - protein, 22 aa, Artificial
  Consensus peptide
NTLRCPLGDRLNVEVDTAPTVD

SEQ ID NO: 1786 - protein, 22 aa, Artificial
  Consensus peptide
NTLRSQLGDRLNVEVDAAPTVD

SEQ ID NO: 1787 - protein, 22 aa, Artificial
  Consensus peptide
NTLRSQLGDRLNVEVDTAPTVD

SEQ ID NO: 1788 - protein, 22 aa, Artificial
  Consensus peptide
NTLRSPLGDRLNVEVDAAPTVD

SEQ ID NO: 1789 - protein, 22 aa, Artificial
  Consensus peptide
NTLRSPLGDRLNVEVDTAPTVD

SEQ ID NO: 1790 - protein, 22 aa, Artificial
  Consensus peptide
TLRCQLGDRLNVEVDAAPTVDL

SEQ ID NO: 1791 - protein, 22 aa, Artificial
  Consensus peptide
TLRCQLGDRLNVEVDTAPTVDL

SEQ ID NO: 1792 - protein, 22 aa, Artificial
  Consensus peptide
TLRCPLGDRLNVEVDAAPTVDL

SEQ ID NO: 1793 - protein, 22 aa, Artificial
  Consensus peptide
TLRCPLGDRLNVEVDTAPTVDL

SEQ ID NO: 1794 - protein, 22 aa, Artificial
  Consensus peptide
TLRSQLGDRLNVEVDAAPTVDL

SEQ ID NO: 1795 - protein, 22 aa, Artificial
  Consensus peptide
TLRSQLGDRLNVEVDTAPTVDL

SEQ ID NO: 1796 - protein, 22 aa, Artificial
  Consensus peptide
TLRSPLGDRLNVEVDAAPTVDL

SEQ ID NO: 1797 - protein, 22 aa, Artificial
  Consensus peptide
TLRSPLGDRLNVEVDTAPTVDL

SEQ ID NO: 1798 - protein, 22 aa, Artificial
  Consensus peptide
LRCQLGDRLNVEVDAAPTVDLN

SEQ ID NO: 1799 - protein, 22 aa, Artificial
  Consensus peptide
LRCQLGDRLNVEVDTAPTVDLN

SEQ ID NO: 1800 - protein, 22 aa, Artificial
  Consensus peptide
LRCPLGDRLNVEVDAAPTVDLN

SEQ ID NO: 1801 - protein, 22 aa, Artificial
  Consensus peptide
LRCPLGDRLNVEVDTAPTVDLN

SEQ ID NO: 1802 - protein, 22 aa, Artificial
  Consensus peptide
LRSQLGDRLNVEVDAAPTVDLN

SEQ ID NO: 1803 - protein, 22 aa, Artificial
  Consensus peptide
LRSQLGDRLNVEVDTAPTVDLN

SEQ ID NO: 1804 - protein, 22 aa, Artificial
  Consensus peptide
LRSPLGDRLNVEVDAAPTVDLN

SEQ ID NO: 1805 - protein, 22 aa, Artificial
  Consensus peptide
LRSPLGDRLNVEVDTAPTVDLN

SEQ ID NO: 1806 - protein, 22 aa, Artificial
  Consensus peptide
RCQLGDRLNVEVDAAPTVDLNQ

SEQ ID NO: 1807 - protein, 22 aa, Artificial
  Consensus peptide
RSQLGDRLNVEVDAAPTVDLNQ

SEQ ID NO: 1808 - protein, 22 aa, Artificial
  Consensus peptide
RCPLGDRLNVEVDAAPTVDLNQ

SEQ ID NO: 1809 - protein, 22 aa, Artificial
  Consensus peptide
RSPLGDRLNVEVDAAPTVDLNQ

SEQ ID NO: 1810 - protein, 22 aa, Artificial
  Consensus peptide
RCQLGDRLNVEVDTAPTVDLNQ

SEQ ID NO: 1811 - protein, 22 aa, Artificial
  Consensus peptide
RSQLGDRLNVEVDTAPTVDLNQ

SEQ ID NO: 1812 - protein, 22 aa, Artificial
  Consensus peptide
RCPLGDRLNVEVDTAPTVDLNQ

SEQ ID NO: 1813 - protein, 22 aa, Artificial
  Consensus peptide
RSPLGDRLNVEVDTAPTVDLNQ

SEQ ID NO: 1814 - protein, 22 aa, Artificial
  Consensus peptide
RCQLGDRLNVEVDAAPTVDLNR

SEQ ID NO: 1815 - protein, 22 aa, Artificial
  Consensus peptide
RSQLGDRLNVEVDAAPTVDLNR

SEQ ID NO: 1816 - protein, 22 aa, Artificial
  Consensus peptide
RCPLGDRLNVEVDAAPTVDLNR

SEQ ID NO: 1817 - protein, 22 aa, Artificial
  Consensus peptide
RSPLGDRLNVEVDAAPTVDLNR

SEQ ID NO: 1818 - protein, 22 aa, Artificial
  Consensus peptide
RCQLGDRLNVEVDTAPTVDLNR

SEQ ID NO: 1819 - protein, 22 aa, Artificial
  Consensus peptide
RSQLGDRLNVEVDTAPTVDLNR

SEQ ID NO: 1820 - protein, 22 aa, Artificial
  Consensus peptide
RCPLGDRLNVEVDTAPTVDLNR

SEQ ID NO: 1821 - protein, 22 aa, Artificial
  Consensus peptide
RSPLGDRLNVEVDTAPTVDLNR

SEQ ID NO: 1822 - protein, 22 aa, Artificial
  Consensus peptide
CQLGDRLNVEVDAAPTVDLNQV

SEQ ID NO: 1823 - protein, 22 aa, Artificial
  Consensus peptide
SQLGDRLNVEVDAAPTVDLNQV

SEQ ID NO: 1824 - protein, 22 aa, Artificial
  Consensus peptide
CPLGDRLNVEVDAAPTVDLNQV

SEQ ID NO: 1825 - protein, 22 aa, Artificial
  Consensus peptide
SPLGDRLNVEVDAAPTVDLNQV

SEQ ID NO: 1826 - protein, 22 aa, Artificial
  Consensus peptide
CQLGDRLNVEVDTAPTVDLNQV

SEQ ID NO: 1827 - protein, 22 aa, Artificial
  Consensus peptide
SQLGDRLNVEVDTAPTVDLNQV

SEQ ID NO: 1828 - protein, 22 aa, Artificial
  Consensus peptide
CPLGDRLNVEVDTAPTVDLNQV

SEQ ID NO: 1829 - protein, 22 aa, Artificial
  Consensus peptide
SPLGDRLNVEVDTAPTVDLNQV

SEQ ID NO: 1830 - protein, 22 aa, Artificial
  Consensus peptide
CQLGDRLNVEVDAAPTVDLNRV

SEQ ID NO: 1831 - protein, 22 aa, Artificial
  Consensus peptide
SQLGDRLNVEVDAAPTVDLNRV

SEQ ID NO: 1832 - protein, 23 aa, Artificial
  Consensus peptide
CPLGDRLNVEVDAAPTVDLNRVL

SEQ ID NO: 1833 - protein, 22 aa, Artificial
  Consensus peptide
SPLGDRLNVEVDAAPTVDLNRV

SEQ ID NO: 1834 - protein, 22 aa, Artificial
  Consensus peptide
CQLGDRLNVEVDTAPTVDLNRV

SEQ ID NO: 1835 - protein, 22 aa, Artificial
  Consensus peptide
SQLGDRLNVEVDTAPTVDLNRV

SEQ ID NO: 1836 - protein, 22 aa, Artificial
  Consensus peptide
CPLGDRLNVEVDTAPTVDLNRV

SEQ ID NO: 1837 - protein, 22 aa, Artificial
  Consensus peptide
SPLGDRLNVEVDTAPTVDLNRV

SEQ ID NO: 1838 - protein, 22 aa, Artificial
  Consensus peptide
QLGDRLNVEVDAAPTVDLNQVL

SEQ ID NO: 1839 - protein, 22 aa, Artificial
  Consensus peptide
QLGDRLNVEVDAAPTVDLNRVL

SEQ ID NO: 1840 - protein, 22 aa, Artificial
  Consensus peptide
QLGDRLNVEVDTAPTVDLNQVL

SEQ ID NO: 1841 - protein, 22 aa, Artificial
  Consensus peptide
QLGDRLNVEVDTAPTVDLNRVL

SEQ ID NO: 1842 - protein, 22 aa, Artificial
  Consensus peptide
PLGDRLNVEVDAAPTVDLNQVL

SEQ ID NO: 1843 - protein, 22 aa, Artificial
  Consensus peptide
PLGDRLNVEVDAAPTVDLNRVL

SEQ ID NO: 1844 - protein, 22 aa, Artificial
  Consensus peptide
PLGDRLNVEVDTAPTVDLNQVL

SEQ ID NO: 1845 - protein, 22 aa, Artificial
  Consensus peptide
PLGDRLNVEVDTAPTVDLNRVL

SEQ ID NO: 1846 - protein, 22 aa, Artificial
  Consensus peptide
LGDRLNVEVDAAPTVDLNQVLN

SEQ ID NO: 1847 - protein, 22 aa, Artificial
  Consensus peptide
LGDRLNVEVDAAPTVDLNRVLN

SEQ ID NO: 1848 - protein, 22 aa, Artificial
  Consensus peptide
LGDRLNVEVDTAPTVDLNQVLN

SEQ ID NO: 1849 - protein, 22 aa, Artificial
  Consensus peptide
LGDRLNVEVDTAPTVDLNRVLN

SEQ ID NO: 1850 - protein, 22 aa, Artificial
  Consensus peptide
GDRLNVEVDAAPTVDLNQVLNE

SEQ ID NO: 1851 - protein, 22 aa, Artificial
  Consensus peptide
GDRLNVEVDAAPTVDLNRVLNE

SEQ ID NO: 1852 - protein, 22 aa, Artificial
  Consensus peptide
GDRLNVEVDTAPTVDLNQVLNE

SEQ ID NO: 1853 - protein, 22 aa, Artificial
  Consensus peptide
GDRLNVEVDTAPTVDLNRVLNE

SEQ ID NO: 1854 - protein, 22 aa, Artificial
  Consensus peptide
DRLNVEVDAAPTVDLNQVLNET

SEQ ID NO: 1855 - protein, 22 aa, Artificial
  Consensus peptide
DRLNVEVDAAPTVDLNRVLNET

SEQ ID NO: 1856 - protein, 22 aa, Artificial
  Consensus peptide
DRLNVEVDTAPTVDLNQVLNET

SEQ ID NO: 1857 - protein, 22 aa, Artificial
  Consensus peptide
DRLNVEVDTAPTVDLNRVLNET

SEQ ID NO: 1858 - protein, 22 aa, Artificial
  Consensus peptide
RLNVEVDAAPTVDLNQVLNETR

SEQ ID NO: 1859 - protein, 22 aa, Artificial
  Consensus peptide
RLNVEVDAAPTVDLNRVLNETR

SEQ ID NO: 1860 - protein, 22 aa, Artificial
  Consensus peptide
RLNVEVDTAPTVDLNQVLNETR

SEQ ID NO: 1861 - protein, 22 aa, Artificial
  Consensus peptide
RLNVEVDTAPTVDLNRVLNETR

SEQ ID NO: 1862 - protein, 22 aa, Artificial
  Consensus peptide
LNVEVDAAPTVDLNQVLNETRS

SEQ ID NO: 1863 - protein, 22 aa, Artificial
  Consensus peptide
LNVEVDAAPTVDLNQVLNETRN

SEQ ID NO: 1864 - protein, 22 aa, Artificial
  Consensus peptide
LNVEVDAAPTVDLNRVLNETRS

SEQ ID NO: 1865 - protein, 22 aa, Artificial
  Consensus peptide
LNVEVDAAPTVDLNRVLNETRN

SEQ ID NO: 1866 - protein, 22 aa, Artificial
  Consensus peptide
LNVEVDTAPTVDLNQVLNETRS

SEQ ID NO: 1867 - protein, 22 aa, Artificial
  Consensus peptide
LNVEVDTAPTVDLNQVLNETRN

SEQ ID NO: 1868 - protein, 22 aa, Artificial
  Consensus peptide
LNVEVDTAPTVDLNRVLNETRS

SEQ ID NO: 1869 - protein, 22 aa, Artificial
  Consensus peptide
LNVEVDTAPTVDLNRVLNETRN

SEQ ID NO: 1870 - protein, 22 aa, Artificial
  Consensus peptide
NVEVDAAPTVDLNQVLNETRSQ

SEQ ID NO: 1871 - protein, 22 aa, Artificial
  Consensus peptide
NVEVDAAPTVDLNQVLNETRNQ

SEQ ID NO: 1872 - protein, 22 aa, Artificial
  Consensus peptide
NVEVDAAPTVDLNRVLNETRSQ

SEQ ID NO: 1873 - protein, 22 aa, Artificial
  Consensus peptide
NVEVDAAPTVDLNRVLNETRNQ

SEQ ID NO: 1874 - protein, 22 aa, Artificial
  Consensus peptide
NVEVDTAPTVDLNQVLNETRSQ

SEQ ID NO: 1875 - protein, 22 aa, Artificial
  Consensus peptide
NVEVDTAPTVDLNQVLNETRNQ

SEQ ID NO: 1876 - protein, 22 aa, Artificial
  Consensus peptide
NVEVDTAPTVDLNRVLNETRSQ

SEQ ID NO: 1877 - protein, 22 aa, Artificial
  Consensus peptide
NVEVDTAPTVDLNRVLNETRNQ

SEQ ID NO: 1878 - protein, 23 aa, Artificial
  Consensus peptide
EVNTLRCQLGDRLNVEVDAAPTV

SEQ ID NO: 1879 - protein, 23 aa, Artificial
  Consensus peptide
EVNTLRCQLGDRLNVEVDTAPTV

SEQ ID NO: 1880 - protein, 23 aa, Artificial
  Consensus peptide
EVNTLRCPLGDRLNVEVDAAPTV

SEQ ID NO: 1881 - protein, 23 aa, Artificial
  Consensus peptide
EVNTLRCPLGDRLNVEVDTAPTV

SEQ ID NO: 1882 - protein, 23 aa, Artificial
  Consensus peptide
EVNTLRSQLGDRLNVEVDAAPTV

SEQ ID NO: 1883 - protein, 23 aa, Artificial
  Consensus peptide
EVNTLRSQLGDRLNVEVDTAPTV

SEQ ID NO: 1884 - protein, 23 aa, Artificial
  Consensus peptide
EVNTLRSPLGDRLNVEVDAAPTV

SEQ ID NO: 1885 - protein, 23 aa, Artificial
  Consensus peptide
EVNTLRSPLGDRLNVEVDTAPTV

SEQ ID NO: 1886 - protein, 23 aa, Artificial
  Consensus peptide
VNTLRCQLGDRLNVEVDAAPTVD

SEQ ID NO: 1887 - protein, 23 aa, Artificial
  Consensus peptide
VNTLRSQLGDRLNVEVDAAPTVD

SEQ ID NO: 1888 - protein, 23 aa, Artificial
  Consensus peptide
VNTLRCPLGDRLNVEVDAAPTVD

SEQ ID NO: 1889 - protein, 23 aa, Artificial
  Consensus peptide
VNTLRSPLGDRLNVEVDAAPTVD

SEQ ID NO: 1890 - protein, 23 aa, Artificial
  Consensus peptide
VNTLRCQLGDRLNVEVDTAPTVD

SEQ ID NO: 1891 - protein, 23 aa, Artificial
  Consensus peptide
VNTLRSQLGDRLNVEVDTAPTVD

SEQ ID NO: 1892 - protein, 23 aa, Artificial
  Consensus peptide
VNTLRCPLGDRLNVEVDTAPTVD

SEQ ID NO: 1893 - protein, 23 aa, Artificial
  Consensus peptide
VNTLRSPLGDRLNVEVDTAPTVD

SEQ ID NO: 1894 - protein, 23 aa, Artificial
  Consensus peptide
NTLRCQLGDRLNVEVDAAPTVDL

SEQ ID NO: 1895 - protein, 23 aa, Artificial
  Consensus peptide
NTLRSQLGDRLNVEVDAAPTVDL

SEQ ID NO: 1896 - protein, 23 aa, Artificial
  Consensus peptide
NTLRCPLGDRLNVEVDAAPTVDL

SEQ ID NO: 1897 - protein, 23 aa, Artificial
  Consensus peptide
NTLRSPLGDRLNVEVDAAPTVDL

SEQ ID NO: 1898 - protein, 23 aa, Artificial
  Consensus peptide
NTLRCQLGDRLNVEVDTAPTVDL

SEQ ID NO: 1899 - protein, 23 aa, Artificial
  Consensus peptide
NTLRSQLGDRLNVEVDTAPTVDL

SEQ ID NO: 1900 - protein, 23 aa, Artificial
  Consensus peptide
NTLRCPLGDRLNVEVDTAPTVDL

SEQ ID NO: 1901 - protein, 23 aa, Artificial
  Consensus peptide
NTLRSPLGDRLNVEVDTAPTVDL

SEQ ID NO: 1902 - protein, 23 aa, Artificial
  Consensus peptide
TLRCQLGDRLNVEVDAAPTVDLN

SEQ ID NO: 1903 - protein, 23 aa, Artificial
  Consensus peptide
TLRSQLGDRLNVEVDAAPTVDLN

SEQ ID NO: 1904 - protein, 23 aa, Artificial
  Consensus peptide
TLRCPLGDRLNVEVDAAPTVDLN

SEQ ID NO: 1905 - protein, 23 aa, Artificial
  Consensus peptide
TLRSPLGDRLNVEVDAAPTVDLN

SEQ ID NO: 1906 - protein, 23 aa, Artificial
  Consensus peptide
TLRCQLGDRLNVEVDTAPTVDLN

SEQ ID NO: 1907 - protein, 23 aa, Artificial
  Consensus peptide
TLRSQLGDRLNVEVDTAPTVDLN

SEQ ID NO: 1908 - protein, 23 aa, Artificial
  Consensus peptide
TLRCPLGDRLNVEVDTAPTVDLN

SEQ ID NO: 1909 - protein, 23 aa, Artificial
  Consensus peptide
TLRSPLGDRLNVEVDTAPTVDLN

SEQ ID NO: 1910 - protein, 23 aa, Artificial
  Consensus peptide
LRCQLGDRLNVEVDAAPTVDLNQ

SEQ ID NO: 1911 - protein, 23 aa, Artificial
  Consensus peptide
LRSQLGDRLNVEVDAAPTVDLNQ

SEQ ID NO: 1912 - protein, 23 aa, Artificial
  Consensus peptide
LRCPLGDRLNVEVDAAPTVDLNQ

SEQ ID NO: 1913 - protein, 23 aa, Artificial
  Consensus peptide
LRSPLGDRLNVEVDAAPTVDLNQ

SEQ ID NO: 1914 - protein, 23 aa, Artificial
  Consensus peptide
LRCQLGDRLNVEVDTAPTVDLNQ

SEQ ID NO: 1915 - protein, 23 aa, Artificial
  Consensus peptide
LRSQLGDRLNVEVDTAPTVDLNQ

SEQ ID NO: 1916 - protein, 23 aa, Artificial
  Consensus peptide
LRCPLGDRLNVEVDTAPTVDLNQ

SEQ ID NO: 1917 - protein, 23 aa, Artificial
  Consensus peptide
LRSPLGDRLNVEVDTAPTVDLNQ

SEQ ID NO: 1918 - protein, 23 aa, Artificial
  Consensus peptide
LRCQLGDRLNVEVDAAPTVDLNR

SEQ ID NO: 1919 - protein, 23 aa, Artificial
  Consensus peptide
LRSQLGDRLNVEVDAAPTVDLNR

SEQ ID NO: 1920 - protein, 23 aa, Artificial
  Consensus peptide
LRCPLGDRLNVEVDAAPTVDLNR

SEQ ID NO: 1921 - protein, 23 aa, Artificial
  Consensus peptide
LRSPLGDRLNVEVDAAPTVDLNR

SEQ ID NO: 1922 - protein, 23 aa, Artificial
  Consensus peptide
LRCQLGDRLNVEVDTAPTVDLNR

SEQ ID NO: 1923 - protein, 23 aa, Artificial
  Consensus peptide
LRSQLGDRLNVEVDTAPTVDLNR

SEQ ID NO: 1924 - protein, 23 aa, Artificial
  Consensus peptide
LRCPLGDRLNVEVDTAPTVDLNR

SEQ ID NO: 1925 - protein, 23 aa, Artificial
  Consensus peptide
LRSPLGDRLNVEVDTAPTVDLNR

SEQ ID NO: 1926 - protein, 23 aa, Artificial
  Consensus peptide
RCQLGDRLNVEVDAAPTVDLNQV

SEQ ID NO: 1927 - protein, 23 aa, Artificial
  Consensus peptide
RSQLGDRLNVEVDAAPTVDLNQV

SEQ ID NO: 1928 - protein, 23 aa, Artificial
  Consensus peptide
RCPLGDRLNVEVDAAPTVDLNQV

SEQ ID NO: 1929 - protein, 23 aa, Artificial
  Consensus peptide
RSPLGDRLNVEVDAAPTVDLNQV

SEQ ID NO: 1930 - protein, 23 aa, Artificial
  Consensus peptide
RCQLGDRLNVEVDTAPTVDLNQV

SEQ ID NO: 1931 - protein, 23 aa, Artificial
  Consensus peptide
RSQLGDRLNVEVDTAPTVDLNQV

SEQ ID NO: 1932 - protein, 23 aa, Artificial
  Consensus peptide
RCPLGDRLNVEVDTAPTVDLNQV

SEQ ID NO: 1933 - protein, 23 aa, Artificial
  Consensus peptide
RSPLGDRLNVEVDTAPTVDLNQV

SEQ ID NO: 1934 - protein, 23 aa, Artificial
  Consensus peptide
RCQLGDRLNVEVDAAPTVDLNRV

SEQ ID NO: 1935 - protein, 23 aa, Artificial
  Consensus peptide
RSQLGDRLNVEVDAAPTVDLNRV

SEQ ID NO: 1936 - protein, 23 aa, Artificial
  Consensus peptide
RCPLGDRLNVEVDAAPTVDLNRV

SEQ ID NO: 1937 - protein, 23 aa, Artificial
  Consensus peptide
RSPLGDRLNVEVDAAPTVDLNRV

SEQ ID NO: 1938 - protein, 23 aa, Artificial
  Consensus peptide
RCQLGDRLNVEVDTAPTVDLNRV

SEQ ID NO: 1939 - protein, 23 aa, Artificial
  Consensus peptide
RSQLGDRLNVEVDTAPTVDLNRV

SEQ ID NO: 1940 - protein, 23 aa, Artificial
  Consensus peptide
RCPLGDRLNVEVDTAPTVDLNRV

SEQ ID NO: 1941 - protein, 23 aa, Artificial
  Consensus peptide
RSPLGDRLNVEVDTAPTVDLNRV

SEQ ID NO: 1942 - protein, 23 aa, Artificial
  Consensus peptide
CQLGDRLNVEVDAAPTVDLNQVL

SEQ ID NO: 1943 - protein, 23 aa, Artificial
  Consensus peptide
SQLGDRLNVEVDAAPTVDLNQVL

SEQ ID NO: 1944 - protein, 23 aa, Artificial
  Consensus peptide
CPLGDRLNVEVDAAPTVDLNQVL

SEQ ID NO: 1945 - protein, 23 aa, Artificial
  Consensus peptide
SPLGDRLNVEVDAAPTVDLNQVL

SEQ ID NO: 1946 - protein, 23 aa, Artificial
  Consensus peptide
CQLGDRLNVEVDTAPTVDLNQVL

SEQ ID NO: 1947 - protein, 23 aa, Artificial
  Consensus peptide
SQLGDRLNVEVDTAPTVDLNQVL

SEQ ID NO: 1948 - protein, 23 aa, Artificial
  Consensus peptide
CPLGDRLNVEVDTAPTVDLNQVL

SEQ ID NO: 1949 - protein, 23 aa, Artificial
  Consensus peptide
SPLGDRLNVEVDTAPTVDLNQVL

SEQ ID NO: 1950 - protein, 23 aa, Artificial
  Consensus peptide
CQLGDRLNVEVDAAPTVDLNRVL

SEQ ID NO: 1951 - protein, 23 aa, Artificial
  Consensus peptide
SQLGDRLNVEVDAAPTVDLNRVL

SEQ ID NO: 1952 - protein, 23 aa, Artificial
  Consensus peptide
CPLGDRLNVEVDAAPTVDLNRVL

SEQ ID NO: 1953 - protein, 23 aa, Artificial
  Consensus peptide
SPLGDRLNVEVDAAPTVDLNRVL

SEQ ID NO: 1954 - protein, 23 aa, Artificial
  Consensus peptide
CQLGDRLNVEVDTAPTVDLNRVL

SEQ ID NO: 1955 - protein, 23 aa, Artificial
  Consensus peptide
SQLGDRLNVEVDTAPTVDLNRVL

SEQ ID NO: 1956 - protein, 23 aa, Artificial
  Consensus peptide
CPLGDRLNVEVDTAPTVDLNRVL

SEQ ID NO: 1957 - protein, 23 aa, Artificial
  Consensus peptide
SPLGDRLNVEVDTAPTVDLNRVL

SEQ ID NO: 1958 - protein, 23 aa, Artificial
  Consensus peptide
QLGDRLNVEVDAAPTVDLNQVLN

SEQ ID NO: 1959 - protein, 23 aa, Artificial
  Consensus peptide
PLGDRLNVEVDAAPTVDLNQVLN

SEQ ID NO: 1960 - protein, 23 aa, Artificial
  Consensus peptide
QLGDRLNVEVDTAPTVDLNQVLN

SEQ ID NO: 1961 - protein, 23 aa, Artificial
  Consensus peptide
PLGDRLNVEVDTAPTVDLNQVLN

SEQ ID NO: 1962 - protein, 23 aa, Artificial
  Consensus peptide
QLGDRLNVEVDAAPTVDLNRVLN

SEQ ID NO: 1963 - protein, 23 aa, Artificial
  Consensus peptide
PLGDRLNVEVDAAPTVDLNRVLN

SEQ ID NO: 1964 - protein, 23 aa, Artificial
  Consensus peptide
QLGDRLNVEVDTAPTVDLNRVLN

SEQ ID NO: 1965 - protein, 23 aa, Artificial
  Consensus peptide
PLGDRLNVEVDTAPTVDLNRVLN

SEQ ID NO: 1966 - protein, 23 aa, Artificial
  Consensus peptide
LGDRLNVEVDAAPTVDLNQVLNE

SEQ ID NO: 1967 - protein, 23 aa, Artificial
  Consensus peptide
LGDRLNVEVDAAPTVDLNRVLNE

SEQ ID NO: 1968 - protein, 23 aa, Artificial
  Consensus peptide
LGDRLNVEVDTAPTVDLNQVLNE

SEQ ID NO: 1969 - protein, 23 aa, Artificial
  Consensus peptide
LGDRLNVEVDTAPTVDLNQVLNE

SEQ ID NO: 1970 - protein, 23 aa, Artificial
  Consensus peptide
GDRLNVEVDAAPTVDLNQVLNET

SEQ ID NO: 1971 - protein, 23 aa, Artificial
  Consensus peptide
GDRLNVEVDAAPTVDLNRVLNET

SEQ ID NO: 1972 - protein, 23 aa, Artificial
  Consensus peptide
GDRLNVEVDTAPTVDLNQVLNET

SEQ ID NO: 1973 - protein, 23 aa, Artificial
  Consensus peptide
GDRLNVEVDTAPTVDLNRVLNET

SEQ ID NO: 1974 - protein, 23 aa, Artificial
  Consensus peptide
DRLNVEVDAAPTVDLNQVLNETR

SEQ ID NO: 1975 - protein, 23 aa, Artificial
  Consensus peptide
DRLNVEVDAAPTVDLNRVLNETR

SEQ ID NO: 1976 - protein, 23 aa, Artificial
  Consensus peptide
DRLNVEVDTAPTVDLNQVLNETR

SEQ ID NO: 1977 - protein, 23 aa, Artificial
  Consensus peptide
DRLNVEVDTAPTVDLNRVLNETR

SEQ ID NO: 1978 - protein, 23 aa, Artificial
  Consensus peptide
RLNVEVDAAPTVDLNQVLNETRS

SEQ ID NO: 1979 - protein, 23 aa, Artificial
  Consensus peptide
RLNVEVDTAPTVDLNQVLNETRS

SEQ ID NO: 1980 - protein, 23 aa, Artificial
  Consensus peptide
RLNVEVDAAPTVDLNRVLNETRS

SEQ ID NO: 1981 - protein, 23 aa, Artificial
  Consensus peptide
RLNVEVDTAPTVDLNRVLNETRS

SEQ ID NO: 1982 - protein, 23 aa, Artificial
  Consensus peptide
RLNVEVDAAPTVDLNQVLNETRN

SEQ ID NO: 1983 - protein, 23 aa, Artificial
  Consensus peptide
RLNVEVDTAPTVDLNQVLNETRN

SEQ ID NO: 1984 - protein, 23 aa, Artificial
  Consensus peptide
RLNVEVDAAPTVDLNRVLNETRN

SEQ ID NO: 1985 - protein, 23 aa, Artificial
  Consensus peptide
RLNVEVDTAPTVDLNRVLNETRN

SEQ ID NO: 1986 - protein, 23 aa, Artificial
  Consensus peptide
LNVEVDAAPTVDLNQVLNETRSQ

SEQ ID NO: 1987 - protein, 23 aa, Artificial
  Consensus peptide
LNVEVDTAPTVDLNQVLNETRSQ

SEQ ID NO: 1988 - protein, 23 aa, Artificial
  Consensus peptide
LNVEVDAAPTVDLNRVLNETRSQ

SEQ ID NO: 1989 - protein, 23 aa, Artificial
  Consensus peptide
LNVEVDTAPTVDLNRVLNETRSQ

SEQ ID NO: 1990 - protein, 23 aa, Artificial
  Consensus peptide
LNVEVDAAPTVDLNQVLNETRNQ

SEQ ID NO: 1991 - protein, 23 aa, Artificial
  Consensus peptide
LNVEVDTAPTVDLNQVLNETRNQ

SEQ ID NO: 1992 - protein, 23 aa, Artificial
  Consensus peptide
LNVEVDAAPTVDLNRVLNETRNQ

SEQ ID NO: 1993 - protein, 23 aa, Artificial
  Consensus peptide
LNVEVDTAPTVDLNRVLNETRNQ

SEQ ID NO: 1994 - protein, 23 aa, Artificial
  Consensus peptide
NVEVDAAPTVDLNQVLNETRSQY

SEQ ID NO: 1995 - protein, 23 aa, Artificial
  Consensus peptide
NVEVDTAPTVDLNQVLNETRSQY

SEQ ID NO: 1996 - protein, 23 aa, Artificial
  Consensus peptide
NVEVDAAPTVDLNRVLNETRSQY

SEQ ID NO: 1997 - protein, 23 aa, Artificial
  Consensus peptide
NVEVDTAPTVDLNRVLNETRSQY

SEQ ID NO: 1998 - protein, 23 aa, Artificial
  Consensus peptide
NVEVDAAPTVDLNQVLNETRNQY

SEQ ID NO: 1999 - protein, 23 aa, Artificial
  Consensus peptide
NVEVDTAPTVDLNQVLNETRNQY

SEQ ID NO: 2000 - protein, 23 aa, Artificial
  Consensus peptide
NVEVDAAPTVDLNRVLNETRNQY

SEQ ID NO: 2001 - protein, 23 aa, Artificial
  Consensus peptide
NVEVDTAPTVDLNRVLNETRNQY

SEQ ID NO: 2002 - protein, 23 aa, Artificial
  Consensus peptide
VEVDAAPTVDLNQVLNETRSQYE

SEQ ID NO: 2003 - protein, 23 aa, Artificial
  Consensus peptide
VEVDTAPTVDLNQVLNETRSQYE

SEQ ID NO: 2004 - protein, 23 aa, Artificial
  Consensus peptide
VEVDAAPTVDLNRVLNETRSQYE

SEQ ID NO: 2005 - protein, 23 aa, Artificial
  Consensus peptide
VEVDTAPTVDLNRVLNETRSQYE

SEQ ID NO: 2006 - protein, 23 aa, Artificial
  Consensus peptide
VEVDAAPTVDLNQVLNETRNQYE

SEQ ID NO: 2007 - protein, 23 aa, Artificial
  Consensus peptide
VEVDTAPTVDLNQVLNETRNQYE

SEQ ID NO: 2008 - protein, 23 aa, Artificial
  Consensus peptide
VEVDAAPTVDLNRVLNETRNQYE

SEQ ID NO: 2009 - protein, 23 aa, Artificial
  Consensus peptide
VEVDTAPTVDLNRVLNETRNQYE

SEQ ID NO: 2010 - protein, 23 aa, Artificial
  Consensus peptide
EVDAAPTVDLNQVLNETRSQYEA

SEQ ID NO: 2011 - protein, 23 aa, Artificial
  Consensus peptide
EVDTAPTVDLNQVLNETRSQYEA

SEQ ID NO: 2012 - protein, 23 aa, Artificial
  Consensus peptide
EVDAAPTVDLNRVLNETRSQYEA

SEQ ID NO: 2013 - protein, 23 aa, Artificial
  Consensus peptide
EVDTAPTVDLNRVLNETRSQYEA

SEQ ID NO: 2014 - protein, 23 aa, Artificial
  Consensus peptide
EVDAAPTVDLNQVLNETRNQYEA

SEQ ID NO: 2015 - protein, 23 aa, Artificial
  Consensus peptide
EVDTAPTVDLNQVLNETRNQYEA

SEQ ID NO: 2016 - protein, 23 aa, Artificial
  Consensus peptide
EVDAAPTVDLNRVLNETRNQYEA

SEQ ID NO: 2017 - protein, 23 aa, Artificial
  Consensus peptide
EVDTAPTVDLNRVLNETRNQYEA

SEQ ID NO: 2018 - protein, 23 aa, Artificial
  Consensus peptide
VDAAPTVDLNQVLNETRSQYEAL

SEQ ID NO: 2019 - protein, 23 aa, Artificial
  Consensus peptide
VDTAPTVDLNQVLNETRSQYEAL

SEQ ID NO: 2020 - protein, 23 aa, Artificial
  Consensus peptide
VDAAPTVDLNRVLNETRSQYEAL

SEQ ID NO: 2021 - protein, 23 aa, Artificial
  Consensus peptide
VDTAPTVDLNRVLNETRSQYEAL

SEQ ID NO: 2022 - protein, 23 aa, Artificial
  Consensus peptide
VDAAPTVDLNQVLNETRNQYEAL

SEQ ID NO: 2023 - protein, 23 aa, Artificial
  Consensus peptide
VDTAPTVDLNQVLNETRNQYEAL

SEQ ID NO: 2024 - protein, 23 aa, Artificial
  Consensus peptide
VDAAPTVDLNRVLNETRNQYEAL

SEQ ID NO: 2025 - protein, 23 aa, Artificial
  Consensus peptide
VDTAPTVDLNRVLNETRNQYEAL

SEQ ID NO: 2026 - protein, 24 aa, Artificial
  Consensus peptide
EVNTLRCQLGDRLNVEVDAAPTVD

SEQ ID NO: 2027 - protein, 24 aa, Artificial
  Consensus peptide
EVNTLRSQLGDRLNVEVDAAPTVD

SEQ ID NO: 2028 - protein, 24 aa, Artificial
  Consensus peptide
EVNTLRCPLGDRLNVEVDAAPTVD

SEQ ID NO: 2029 - protein, 24 aa, Artificial
  Consensus peptide
EVNTLRSPLGDRLNVEVDAAPTVD

SEQ ID NO: 2030 - protein, 24 aa, Artificial
  Consensus peptide
EVNTLRCQLGDRLNVEVDTAPTVD

SEQ ID NO: 2031 - protein, 24 aa, Artificial
  Consensus peptide
EVNTLRSQLGDRLNVEVDTAPTVD

SEQ ID NO: 2032 - protein, 24 aa, Artificial
  Consensus peptide
EVNTLRCPLGDRLNVEVDTAPTVD

SEQ ID NO: 2033 - protein, 24 aa, Artificial
  Consensus peptide
EVNTLRSPLGDRLNVEVDTAPTVD

SEQ ID NO: 2034 - protein, 24 aa, Artificial
  Consensus peptide
VNTLRCQLGDRLNVEVDAAPTVDL

SEQ ID NO: 2035 - protein, 24 aa, Artificial
  Consensus peptide
VNTLRSQLGDRLNVEVDAAPTVDL

SEQ ID NO: 2036 - protein, 24 aa, Artificial
  Consensus peptide
VNTLRCPLGDRLNVEVDAAPTVDL

SEQ ID NO: 2037 - protein, 24 aa, Artificial
  Consensus peptide
VNTLRSPLGDRLNVEVDAAPTVDL

SEQ ID NO: 2038 - protein, 24 aa, Artificial
  Consensus peptide
VNTLRCQLGDRLNVEVDTAPTVDL

SEQ ID NO: 2039 - protein, 24 aa, Artificial
  Consensus peptide
VNTLRSQLGDRLNVEVDTAPTVDL

SEQ ID NO: 2040 - protein, 24 aa, Artificial
  Consensus peptide
VNTLRCPLGDRLNVEVDTAPTVDL

SEQ ID NO: 2041 - protein, 24 aa, Artificial
  Consensus peptide
VNTLRSPLGDRLNVEVDTAPTVDL

SEQ ID NO: 2042 - protein, 24 aa, Artificial
  Consensus peptide
NTLRCQLGDRLNVEVDAAPTVDLN

SEQ ID NO: 2043 - protein, 24 aa, Artificial
  Consensus peptide
NTLRSQLGDRLNVEVDAAPTVDLN

SEQ ID NO: 2044 - protein, 24 aa, Artificial
  Consensus peptide
NTLRCPLGDRLNVEVDAAPTVDLN

SEQ ID NO: 2045 - protein, 24 aa, Artificial
  Consensus peptide
NTLRSPLGDRLNVEVDAAPTVDLN

SEQ ID NO: 2046 - protein, 24 aa, Artificial
  Consensus peptide
NTLRCQLGDRLNVEVDTAPTVDLN

SEQ ID NO: 2047 - protein, 24 aa, Artificial
  Consensus peptide
NTLRSQLGDRLNVEVDTAPTVDLN

SEQ ID NO: 2048 - protein, 24 aa, Artificial
  Consensus peptide
NTLRCPLGDRLNVEVDTAPTVDLN

SEQ ID NO: 2049 - protein, 24 aa, Artificial
  Consensus peptide
NTLRSPLGDRLNVEVDTAPTVDLN

SEQ ID NO: 2050 - protein, 24 aa, Artificial
  Consensus peptide
TLRCQLGDRLNVEVDAAPTVDLNQ

SEQ ID NO: 2051 - protein, 24 aa, Artificial
  Consensus peptide
TLRSQLGDRLNVEVDAAPTVDLNQ

SEQ ID NO: 2052 - protein, 24 aa, Artificial
  Consensus peptide
TLRCPLGDRLNVEVDAAPTVDLNQ

SEQ ID NO: 2053 - protein, 24 aa, Artificial
  Consensus peptide
TLRSPLGDRLNVEVDAAPTVDLNQ

SEQ ID NO: 2054 - protein, 24 aa, Artificial
  Consensus peptide
TLRCQLGDRLNVEVDTAPTVDLNQ

SEQ ID NO: 2055 - protein, 24 aa, Artificial
  Consensus peptide
TLRSQLGDRLNVEVDTAPTVDLNQ

SEQ ID NO: 2056 - protein, 24 aa, Artificial
  Consensus peptide
TLRCPLGDRLNVEVDTAPTVDLNQ

SEQ ID NO: 2057 - protein, 24 aa, Artificial
  Consensus peptide
TLRSPLGDRLNVEVDTAPTVDLNQ

SEQ ID NO: 2058 - protein, 24 aa, Artificial
  Consensus peptide
TLRCQLGDRLNVEVDAAPTVDLNR

SEQ ID NO: 2059 - protein, 24 aa, Artificial
  Consensus peptide
TLRSQLGDRLNVEVDAAPTVDLNR

SEQ ID NO: 2060 - protein, 24 aa, Artificial
  Consensus peptide
TLRCPLGDRLNVEVDAAPTVDLNR

SEQ ID NO: 2061 - protein, 24 aa, Artificial
  Consensus peptide
TLRSPLGDRLNVEVDAAPTVDLNR

SEQ ID NO: 2062 - protein, 24 aa, Artificial
  Consensus peptide
TLRCQLGDRLNVEVDTAPTVDLNR

SEQ ID NO: 2063 - protein, 24 aa, Artificial
  Consensus peptide
TLRSQLGDRLNVEVDTAPTVDLNR

SEQ ID NO: 2064 - protein, 24 aa, Artificial
  Consensus peptide
TLRCPLGDRLNVEVDTAPTVDLNR

SEQ ID NO: 2065 - protein, 24 aa, Artificial
  Consensus peptide
TLRSPLGDRLNVEVDTAPTVDLNR

SEQ ID NO: 2066 - protein, 24 aa, Artificial
  Consensus peptide
LRCQLGDRLNVEVDAAPTVDLNQV

SEQ ID NO: 2067 - protein, 24 aa, Artificial
  Consensus peptide
LRSQLGDRLNVEVDAAPTVDLNQV

SEQ ID NO: 2068 - protein, 24 aa, Artificial
  Consensus peptide
LRCPLGDRLNVEVDAAPTVDLNQV

SEQ ID NO: 2069 - protein, 24 aa, Artificial
  Consensus peptide
LRSPLGDRLNVEVDAAPTVDLNQV

SEQ ID NO: 2070 - protein, 24 aa, Artificial
  Consensus peptide
LRCQLGDRLNVEVDTAPTVDLNQV

SEQ ID NO: 2071 - protein, 24 aa, Artificial
  Consensus peptide
LRSQLGDRLNVEVDTAPTVDLNQV

SEQ ID NO: 2072 - protein, 24 aa, Artificial
  Consensus peptide
LRCPLGDRLNVEVDTAPTVDLNQV

SEQ ID NO: 2073 - protein, 24 aa, Artificial
  Consensus peptide
LRSPLGDRLNVEVDTAPTVDLNQV

SEQ ID NO: 2074 - protein, 24 aa, Artificial
  Consensus peptide
LRCQLGDRLNVEVDAAPTVDLNRV

SEQ ID NO: 2075 - protein, 24 aa, Artificial
  Consensus peptide
LRSQLGDRLNVEVDAAPTVDLNRV

SEQ ID NO: 2076 - protein, 24 aa, Artificial
  Consensus peptide
LRCPLGDRLNVEVDAAPTVDLNRV

SEQ ID NO: 2077 - protein, 24 aa, Artificial
  Consensus peptide
LRSPLGDRLNVEVDAAPTVDLNRV

SEQ ID NO: 2078 - protein, 24 aa, Artificial
  Consensus peptide
LRCQLGDRLNVEVDTAPTVDLNRV

SEQ ID NO: 2079 - protein, 24 aa, Artificial
  Consensus peptide
LRSQLGDRLNVEVDTAPTVDLNRV

SEQ ID NO: 2080 - protein, 24 aa, Artificial
  Consensus peptide
LRCPLGDRLNVEVDTAPTVDLNRV

SEQ ID NO: 2081 - protein, 24 aa, Artificial
  Consensus peptide
LRSPLGDRLNVEVDTAPTVDLNRV

SEQ ID NO: 2082 - protein, 24 aa, Artificial
  Consensus peptide
RCQLGDRLNVEVDAAPTVDLNQVL

SEQ ID NO: 2083 - protein, 24 aa, Artificial
  Consensus peptide
RSQLGDRLNVEVDAAPTVDLNQVL

SEQ ID NO: 2084 - protein, 24 aa, Artificial
  Consensus peptide
RCPLGDRLNVEVDAAPTVDLNQVL

SEQ ID NO: 2085 - protein, 24 aa, Artificial
  Consensus peptide
RSPLGDRLNVEVDAAPTVDLNQVL

SEQ ID NO: 2086 - protein, 24 aa, Artificial
  Consensus peptide
RCQLGDRLNVEVDTAPTVDLNQVL

SEQ ID NO: 2087 - protein, 24 aa, Artificial
  Consensus peptide
RSQLGDRLNVEVDTAPTVDLNQVL

SEQ ID NO: 2088 - protein, 24 aa, Artificial
  Consensus peptide
RCPLGDRLNVEVDTAPTVDLNQVL

SEQ ID NO: 2089 - protein, 24 aa, Artificial
  Consensus peptide
RSPLGDRLNVEVDTAPTVDLNQVL

SEQ ID NO: 2090 - protein, 24 aa, Artificial
  Consensus peptide
RCQLGDRLNVEVDAAPTVDLNRVL

SEQ ID NO: 2091 - protein, 24 aa, Artificial
  Consensus peptide
RSQLGDRLNVEVDAAPTVDLNRVL

SEQ ID NO: 2092 - protein, 24 aa, Artificial
  Consensus peptide
RCPLGDRLNVEVDAAPTVDLNRVL

SEQ ID NO: 2093 - protein, 24 aa, Artificial
  Consensus peptide
RSPLGDRLNVEVDAAPTVDLNRVL

SEQ ID NO: 2094 - protein, 24 aa, Artificial
  Consensus peptide
RCQLGDRLNVEVDTAPTVDLNRVL

SEQ ID NO: 2095 - protein, 24 aa, Artificial
  Consensus peptide
RSQLGDRLNVEVDTAPTVDLNRVL

SEQ ID NO: 2096 - protein, 24 aa, Artificial
  Consensus peptide
RCPLGDRLNVEVDTAPTVDLNRVL

SEQ ID NO: 2097 - protein, 24 aa, Artificial
  Consensus peptide
RSPLGDRLNVEVDTAPTVDLNRVL

SEQ ID NO: 2098 - protein, 24 aa, Artificial
  Consensus peptide
CQLGDRLNVEVDAAPTVDLNQVLN

SEQ ID NO: 2099 - protein, 24 aa, Artificial
  Consensus peptide
SQLGDRLNVEVDAAPTVDLNQVLN

SEQ ID NO: 2100 - protein, 24 aa, Artificial
  Consensus peptide
CPLGDRLNVEVDAAPTVDLNQVLN

SEQ ID NO: 2101 - protein, 24 aa, Artificial
  Consensus peptide
SPLGDRLNVEVDAAPTVDLNQVLN

SEQ ID NO: 2102 - protein, 24 aa, Artificial
  Consensus peptide
CQLGDRLNVEVDTAPTVDLNQVLN

SEQ ID NO: 2103 - protein, 24 aa, Artificial
  Consensus peptide
SQLGDRLNVEVDTAPTVDLNQVLN

SEQ ID NO: 2104 - protein, 24 aa, Artificial
  Consensus peptide
CPLGDRLNVEVDTAPTVDLNQVLN

SEQ ID NO: 2105 - protein, 24 aa, Artificial
  Consensus peptide
SPLGDRLNVEVDTAPTVDLNQVLN

SEQ ID NO: 2106 - protein, 24 aa, Artificial
  Consensus peptide
CQLGDRLNVEVDAAPTVDLNRVLN

SEQ ID NO: 2107 - protein, 24 aa, Artificial
  Consensus peptide
SQLGDRLNVEVDAAPTVDLNRVLN

SEQ ID NO: 2108 - protein, 24 aa, Artificial
  Consensus peptide
CPLGDRLNVEVDAAPTVDLNRVLN

SEQ ID NO: 2109 - protein, 24 aa, Artificial
  Consensus peptide
SPLGDRLNVEVDAAPTVDLNRVLN

SEQ ID NO: 2110 - protein, 24 aa, Artificial
  Consensus peptide
CQLGDRLNVEVDTAPTVDLNRVLN

SEQ ID NO: 2111 - protein, 24 aa, Artificial
  Consensus peptide
SQLGDRLNVEVDTAPTVDLNRVLN

SEQ ID NO: 2112 - protein, 24 aa, Artificial
  Consensus peptide
CPLGDRLNVEVDTAPTVDLNRVLN

SEQ ID NO: 2113 - protein, 24 aa, Artificial
  Consensus peptide
SPLGDRLNVEVDTAPTVDLNRVLN

SEQ ID NO: 2114 - protein, 24 aa, Artificial
  Consensus peptide
QLGDRLNVEVDAAPTVDLNQVLNE

SEQ ID NO: 2115 - protein, 24 aa, Artificial
  Consensus peptide
PLGDRLNVEVDAAPTVDLNQVLNE

SEQ ID NO: 2116 - protein, 24 aa, Artificial
  Consensus peptide
QLGDRLNVEVDTAPTVDLNQVLNE

SEQ ID NO: 2117 - protein, 24 aa, Artificial
  Consensus peptide
PLGDRLNVEVDTAPTVDLNQVLNE

SEQ ID NO: 2118 - protein, 24 aa, Artificial
  Consensus peptide
QLGDRLNVEVDAAPTVDLNRVLNE

SEQ ID NO: 2119 - protein, 24 aa, Artificial
  Consensus peptide
PLGDRLNVEVDAAPTVDLNRVLNE

SEQ ID NO: 2120 - protein, 24 aa, Artificial
  Consensus peptide
QLGDRLNVEVDTAPTVDLNRVLNE

SEQ ID NO: 2121 - protein, 24 aa, Artificial
  Consensus peptide
PLGDRLNVEVDTAPTVDLNRVLNE

SEQ ID NO: 2122 - protein, 24 aa, Artificial
  Consensus peptide
LGDRLNVEVDAAPTVDLNQVLNET

SEQ ID NO: 2123 - protein, 24 aa, Artificial
  Consensus peptide
LGDRLNVEVDAAPTVDLNRVLNET

SEQ ID NO: 2124 - protein, 24 aa, Artificial
  Consensus peptide
LGDRLNVEVDTAPTVDLNQVLNET

SEQ ID NO: 2125 - protein, 24 aa, Artificial
  Consensus peptide
LGDRLNVEVDTAPTVDLNRVLNET

SEQ ID NO: 2126 - protein, 24 aa, Artificial
  Consensus peptide
GDRLNVEVDAAPTVDLNQVLNETR

SEQ ID NO: 2127 - protein, 24 aa, Artificial
  Consensus peptide
GDRLNVEVDAAPTVDLNRVLNETR

SEQ ID NO: 2128 - protein, 24 aa, Artificial
  Consensus peptide
GDRLNVEVDTAPTVDLNQVLNETR

SEQ ID NO: 2129 - protein, 24 aa, Artificial
  Consensus peptide
GDRLNVEVDTAPTVDLNRVLNETR

SEQ ID NO: 2130 - protein, 24 aa, Artificial
  Consensus peptide
DRLNVEVDAAPTVDLNQVLNETRS

SEQ ID NO: 2131 - protein, 24 aa, Artificial
  Consensus peptide
DRLNVEVDTAPTVDLNQVLNETRS

SEQ ID NO: 2132 - protein, 24 aa, Artificial
  Consensus peptide
DRLNVEVDAAPTVDLNRVLNETRS

SEQ ID NO: 2133 - protein, 24 aa, Artificial
  Consensus peptide
DRLNVEVDTAPTVDLNRVLNETRS

SEQ ID NO: 2134 - protein, 24 aa, Artificial
  Consensus peptide
DRLNVEVDAAPTVDLNQVLNETRN

SEQ ID NO: 2135 - protein, 24 aa, Artificial
  Consensus peptide
DRLNVEVDTAPTVDLNQVLNETRN

SEQ ID NO: 2136 - protein, 24 aa, Artificial
  Consensus peptide
DRLNVEVDAAPTVDLNRVLNETRN

SEQ ID NO: 2137 - protein, 24 aa, Artificial
  Consensus peptide
DRLNVEVDTAPTVDLNRVLNETRN

SEQ ID NO: 2138 - protein, 24 aa, Artificial
  Consensus peptide
RLNVEVDAAPTVDLNQVLNETRSQ

SEQ ID NO: 2139 - protein, 24 aa, Artificial
  Consensus peptide
RLNVEVDTAPTVDLNQVLNETRSQ

SEQ ID NO: 2140 - protein, 24 aa, Artificial
  Consensus peptide
RLNVEVDAAPTVDLNRVLNETRSQ

SEQ ID NO: 2141 - protein, 24 aa, Artificial
  Consensus peptide
RLNVEVDTAPTVDLNRVLNETRSQ

SEQ ID NO: 2142 - protein, 24 aa, Artificial
  Consensus peptide
RLNVEVDAAPTVDLNQVLNETRNQ

SEQ ID NO: 2143 - protein, 24 aa, Artificial
  Consensus peptide
RLNVEVDTAPTVDLNQVLNETRNQ

SEQ ID NO: 2144 - protein, 24 aa, Artificial
  Consensus peptide
RLNVEVDAAPTVDLNRVLNETRNQ

SEQ ID NO: 2145 - protein, 24 aa, Artificial
  Consensus peptide
RLNVEVDTAPTVDLNRVLNETRNQ

SEQ ID NO: 2146 - protein, 24 aa, Artificial
  Consensus peptide
LNVEVDAAPTVDLNQVLNETRSQY

SEQ ID NO: 2147 - protein, 24 aa, Artificial
  Consensus peptide
LNVEVDTAPTVDLNQVLNETRSQY

SEQ ID NO: 2148 - protein, 24 aa, Artificial
  Consensus peptide
LNVEVDAAPTVDLNRVLNETRSQY

SEQ ID NO: 2149 - protein, 24 aa, Artificial
  Consensus peptide
LNVEVDTAPTVDLNRVLNETRSQY

SEQ ID NO: 2150 - protein, 24 aa, Artificial
  Consensus peptide
LNVEVDAAPTVDLNQVLNETRNQY

SEQ ID NO: 2151 - protein, 24 aa, Artificial
  Consensus peptide
LNVEVDTAPTVDLNQVLNETRNQY

SEQ ID NO: 2152 - protein, 24 aa, Artificial
  Consensus peptide
LNVEVDAAPTVDLNRVLNETRNQY

SEQ ID NO: 2153 - protein, 24 aa, Artificial
  Consensus peptide
LNVEVDTAPTVDLNRVLNETRNQY

SEQ ID NO: 2154 - protein, 24 aa, Artificial
  Consensus peptide
NVEVDAAPTVDLNQVLNETRSQYE

SEQ ID NO: 2155 - protein, 24 aa, Artificial
  Consensus peptide
NVEVDTAPTVDLNQVLNETRSQYE

SEQ ID NO: 2156 - protein, 24 aa, Artificial
  Consensus peptide
NVEVDAAPTVDLNRVLNETRSQYE

SEQ ID NO: 2157 - protein, 24 aa, Artificial
  Consensus peptide
NVEVDTAPTVDLNRVLNETRSQYE

SEQ ID NO: 2158 - protein, 24 aa, Artificial
  Consensus peptide
NVEVDAAPTVDLNQVLNETRNQYE

SEQ ID NO: 2159 - protein, 24 aa, Artificial
  Consensus peptide
NVEVDTAPTVDLNQVLNETRNQYE

SEQ ID NO: 2160 - protein, 24 aa, Artificial
  Consensus peptide
NVEVDAAPTVDLNRVLNETRNQYE

SEQ ID NO: 2161 - protein, 24 aa, Artificial
  Consensus peptide
NVEVDTAPTVDLNRVLNETRNQYE

SEQ ID NO: 2162 - protein, 24 aa, Artificial
  Consensus peptide
VEVDAAPTVDLNQVLNETRSQYEA

SEQ ID NO: 2163 - protein, 24 aa, Artificial
  Consensus peptide
VEVDTAPTVDLNQVLNETRSQYEA

SEQ ID NO: 2164 - protein, 24 aa, Artificial
  Consensus peptide
VEVDAAPTVDLNRVLNETRSQYEA

SEQ ID NO: 2165 - protein, 24 aa, Artificial
  Consensus peptide
VEVDTAPTVDLNRVLNETRSQYEA

SEQ ID NO: 2166 - protein, 24 aa, Artificial
  Consensus peptide
VEVDAAPTVDLNQVLNETRNQYEA

SEQ ID NO: 2167 - protein, 24 aa, Artificial
  Consensus peptide
VEVDTAPTVDLNQVLNETRNQYEA

SEQ ID NO: 2168 - protein, 24 aa, Artificial
  Consensus peptide
VEVDAAPTVDLNRVLNETRNQYEA

SEQ ID NO: 2169 - protein, 24 aa, Artificial
  Consensus peptide
VEVDTAPTVDLNRVLNETRNQYEA

SEQ ID NO: 2170 - protein, 24 aa, Artificial
  Consensus peptide
EVDAAPTVDLNQVLNETRSQYEAL

SEQ ID NO: 2171 - protein, 24 aa, Artificial
  Consensus peptide
EVDTAPTVDLNQVLNETRSQYEAL

SEQ ID NO: 2172 - protein, 24 aa, Artificial
  Consensus peptide
EVDAAPTVDLNRVLNETRSQYEAL

SEQ ID NO: 2173 - protein, 24 aa, Artificial
  Consensus peptide
EVDTAPTVDLNRVLNETRSQYEAL

SEQ ID NO: 2174 - protein, 24 aa, Artificial
  Consensus peptide
EVDAAPTVDLNQVLNETRNQYEAL

SEQ ID NO: 2175 - protein, 24 aa, Artificial
  Consensus peptide
EVDTAPTVDLNQVLNETRNQYEAL

SEQ ID NO: 2176 - protein, 24 aa, Artificial
  Consensus peptide
EVDAAPTVDLNRVLNETRNQYEAL

SEQ ID NO: 2177 - protein, 24 aa, Artificial
  Consensus peptide
EVDTAPTVDLNRVLNETRNQYEAL

SEQ ID NO: 2178 - protein, 25 aa, Artificial
  Consensus peptide
EVNTLRCQLGDRLNVEVDAAPTVDL

SEQ ID NO: 2179 - protein, 25 aa, Artificial
  Consensus peptide
EVNTLRSQLGDRLNVEVDAAPTVDL

SEQ ID NO: 2180 - protein, 25 aa, Artificial
  Consensus peptide
EVNTLRCPLGDRLNVEVDAAPTVDL

SEQ ID NO: 2181 - protein, 25 aa, Artificial
  Consensus peptide
EVNTLRSPLGDRLNVEVDAAPTVDL

SEQ ID NO: 2182 - protein, 25 aa, Artificial
  Consensus peptide
EVNTLRCQLGDRLNVEVDTAPTVDL

SEQ ID NO: 2183 - protein, 25 aa, Artificial
  Consensus peptide
EVNTLRSQLGDRLNVEVDTAPTVDL

SEQ ID NO: 2184 - protein, 25 aa, Artificial
  Consensus peptide
EVNTLRCPLGDRLNVEVDTAPTVDL

SEQ ID NO: 2185 - protein, 25 aa, Artificial
  Consensus peptide
EVNTLRSPLGDRLNVEVDTAPTVDL

SEQ ID NO: 2186 - protein, 25 aa, Artificial
  Consensus peptide
VNTLRCQLGDRLNVEVDAAPTVDLN

SEQ ID NO: 2187 - protein, 25 aa, Artificial
  Consensus peptide
VNTLRSQLGDRLNVEVDAAPTVDLN

SEQ ID NO: 2188 - protein, 25 aa, Artificial
  Consensus peptide
VNTLRCPLGDRLNVEVDAAPTVDLN

SEQ ID NO: 2189 - protein, 25 aa, Artificial
  Consensus peptide
VNTLRSPLGDRLNVEVDAAPTVDLN

SEQ ID NO: 2190 - protein, 25 aa, Artificial
  Consensus peptide
VNTLRCQLGDRLNVEVDTAPTVDLN

SEQ ID NO: 2191 - protein, 25 aa, Artificial
  Consensus peptide
VNTLRSQLGDRLNVEVDTAPTVDLN

SEQ ID NO: 2192 - protein, 25 aa, Artificial
  Consensus peptide
VNTLRCPLGDRLNVEVDTAPTVDLN

SEQ ID NO: 2193 - protein, 25 aa, Artificial
  Consensus peptide
VNTLRSPLGDRLNVEVDTAPTVDLN

SEQ ID NO: 2194 - protein, 25 aa, Artificial
  Consensus peptide
NTLRCQLGDRLNVEVDAAPTVDLNQ

SEQ ID NO: 2195 - protein, 25 aa, Artificial
  Consensus peptide
NTLRSQLGDRLNVEVDAAPTVDLNQ

SEQ ID NO: 2196 - protein, 25 aa, Artificial
  Consensus peptide
NTLRCPLGDRLNVEVDAAPTVDLNQ

SEQ ID NO: 2197 - protein, 25 aa, Artificial
  Consensus peptide
NTLRSPLGDRLNVEVDAAPTVDLNQ

SEQ ID NO: 2198 - protein, 25 aa, Artificial
  Consensus peptide
NTLRCQLGDRLNVEVDTAPTVDLNQ

SEQ ID NO: 2199 - protein, 25 aa, Artificial
  Consensus peptide
NTLRSQLGDRLNVEVDTAPTVDLNQ

SEQ ID NO: 2200 - protein, 25 aa, Artificial
  Consensus peptide
NTLRCPLGDRLNVEVDTAPTVDLNQ

SEQ ID NO: 2201 - protein, 25 aa, Artificial
  Consensus peptide
NTLRSPLGDRLNVEVDTAPTVDLNQ

SEQ ID NO: 2202 - protein, 25 aa, Artificial
  Consensus peptide
NTLRCQLGDRLNVEVDAAPTVDLNR

SEQ ID NO: 2203 - protein, 25 aa, Artificial
  Consensus peptide
NTLRSQLGDRLNVEVDAAPTVDLNR

SEQ ID NO: 2204 - protein, 25 aa, Artificial
  Consensus peptide
NTLRCPLGDRLNVEVDAAPTVDLNR

SEQ ID NO: 2205 - protein, 25 aa, Artificial
  Consensus peptide
NTLRSPLGDRLNVEVDAAPTVDLNR

SEQ ID NO: 2206 - protein, 25 aa, Artificial
  Consensus peptide
NTLRCQLGDRLNVEVDTAPTVDLNR

SEQ ID NO: 2207 - protein, 25 aa, Artificial
  Consensus peptide
NTLRSQLGDRLNVEVDTAPTVDLNR

SEQ ID NO: 2208 - protein, 25 aa, Artificial
  Consensus peptide
NTLRCPLGDRLNVEVDTAPTVDLNR

SEQ ID NO: 2209 - protein, 25 aa, Artificial
  Consensus peptide
NTLRSPLGDRLNVEVDTAPTVDLNR

SEQ ID NO: 2210 - protein, 25 aa, Artificial
  Consensus peptide
TLRCQLGDRLNVEVDAAPTVDLNQV

SEQ ID NO: 2211 - protein, 25 aa, Artificial
  Consensus peptide
TLRSQLGDRLNVEVDAAPTVDLNQV

SEQ ID NO: 2212 - protein, 25 aa, Artificial
  Consensus peptide
TLRCPLGDRLNVEVDAAPTVDLNQV

SEQ ID NO: 2213 - protein, 25 aa, Artificial
  Consensus peptide
TLRSPLGDRLNVEVDAAPTVDLNQV

SEQ ID NO: 2214 - protein, 25 aa, Artificial
  Consensus peptide
TLRCQLGDRLNVEVDTAPTVDLNQV

SEQ ID NO: 2215 - protein, 25 aa, Artificial
  Consensus peptide
TLRSQLGDRLNVEVDTAPTVDLNQV

SEQ ID NO: 2216 - protein, 25 aa, Artificial
  Consensus peptide
TLRCPLGDRLNVEVDTAPTVDLNQV

SEQ ID NO: 2217 - protein, 25 aa, Artificial
  Consensus peptide
TLRSPLGDRLNVEVDTAPTVDLNQV

SEQ ID NO: 2218 - protein, 25 aa, Artificial
  Consensus peptide
TLRCQLGDRLNVEVDAAPTVDLNRV

SEQ ID NO: 2219 - protein, 25 aa, Artificial
  Consensus peptide
TLRSQLGDRLNVEVDAAPTVDLNRV

SEQ ID NO: 2220 - protein, 25 aa, Artificial
  Consensus peptide
TLRCPLGDRLNVEVDAAPTVDLNRV

SEQ ID NO: 2221 - protein, 25 aa, Artificial
  Consensus peptide
TLRSPLGDRLNVEVDAAPTVDLNRV

SEQ ID NO: 2222 - protein, 25 aa, Artificial
  Consensus peptide
TLRCQLGDRLNVEVDTAPTVDLNRV

SEQ ID NO: 2223 - protein, 25 aa, Artificial
  Consensus peptide
TLRSQLGDRLNVEVDTAPTVDLNRV

SEQ ID NO: 2224 - protein, 25 aa, Artificial
  Consensus peptide
TLRCPLGDRLNVEVDTAPTVDLNRV

SEQ ID NO: 2225 - protein, 25 aa, Artificial
  Consensus peptide
TLRSPLGDRLNVEVDTAPTVDLNRV

SEQ ID NO: 2226 - protein, 25 aa, Artificial
  Consensus peptide
LRCQLGDRLNVEVDAAPTVDLNQVL

SEQ ID NO: 2227 - protein, 25 aa, Artificial
  Consensus peptide
LRSQLGDRLNVEVDAAPTVDLNQVL

SEQ ID NO: 2228 - protein, 25 aa, Artificial
  Consensus peptide
LRCPLGDRLNVEVDAAPTVDLNQVL

SEQ ID NO: 2229 - protein, 25 aa, Artificial
  Consensus peptide
LRSPLGDRLNVEVDAAPTVDLNQVL

SEQ ID NO: 2230 - protein, 25 aa, Artificial
  Consensus peptide
LRCQLGDRLNVEVDTAPTVDLNQVL

SEQ ID NO: 2231 - protein, 25 aa, Artificial
  Consensus peptide
LRSQLGDRLNVEVDTAPTVDLNQVL

SEQ ID NO: 2232 - protein, 25 aa, Artificial
  Consensus peptide
LRCPLGDRLNVEVDTAPTVDLNQVL

SEQ ID NO: 2233 - protein, 25 aa, Artificial
  Consensus peptide
LRSPLGDRLNVEVDTAPTVDLNQVL

SEQ ID NO: 2234 - protein, 25 aa, Artificial
  Consensus peptide
LRCQLGDRLNVEVDAAPTVDLNRVL

SEQ ID NO: 2235 - protein, 25 aa, Artificial
  Consensus peptide
LRSQLGDRLNVEVDAAPTVDLNRVL

SEQ ID NO: 2236 - protein, 25 aa, Artificial
  Consensus peptide
LRCPLGDRLNVEVDAAPTVDLNRVL

SEQ ID NO: 2237 - protein, 25 aa, Artificial
  Consensus peptide
LRSPLGDRLNVEVDAAPTVDLNRVL

SEQ ID NO: 2238 - protein, 25 aa, Artificial
  Consensus peptide
LRCQLGDRLNVEVDTAPTVDLNRVL

SEQ ID NO: 2239 - protein, 25 aa, Artificial
  Consensus peptide
LRSQLGDRLNVEVDTAPTVDLNRVL

SEQ ID NO: 2240 - protein, 25 aa, Artificial
  Consensus peptide
LRCPLGDRLNVEVDTAPTVDLNRVL

SEQ ID NO: 2241 - protein, 24 aa, Artificial
  Consensus peptide
LRSPLGDRLNVEVDTAPTVDLNRV

SEQ ID NO: 2242 - protein, 25 aa, Artificial
  Consensus peptide
RCQLGDRLNVEVDAAPTVDLNQVLN

SEQ ID NO: 2243 - protein, 25 aa, Artificial
  Consensus peptide
RSQLGDRLNVEVDAAPTVDLNQVLN

SEQ ID NO: 2244 - protein, 25 aa, Artificial
  Consensus peptide
RCPLGDRLNVEVDAAPTVDLNQVLN

SEQ ID NO: 2245 - protein, 25 aa, Artificial
  Consensus peptide
RSPLGDRLNVEVDAAPTVDLNQVLN

SEQ ID NO: 2246 - protein, 25 aa, Artificial
  Consensus peptide
RCQLGDRLNVEVDTAPTVDLNQVLN

SEQ ID NO: 2247 - protein, 25 aa, Artificial
  Consensus peptide
RSQLGDRLNVEVDTAPTVDLNQVLN

SEQ ID NO: 2248 - protein, 25 aa, Artificial
  Consensus peptide
RCPLGDRLNVEVDTAPTVDLNQVLN

SEQ ID NO: 2249 - protein, 25 aa, Artificial
  Consensus peptide
RSPLGDRLNVEVDTAPTVDLNQVLN

SEQ ID NO: 2250 - protein, 25 aa, Artificial
  Consensus peptide
RCQLGDRLNVEVDAAPTVDLNRVLN

SEQ ID NO: 2251 - protein, 25 aa, Artificial
  Consensus peptide
RSQLGDRLNVEVDAAPTVDLNRVLN

SEQ ID NO: 2252 - protein, 25 aa, Artificial
  Consensus peptide
RCPLGDRLNVEVDAAPTVDLNRVLN

SEQ ID NO: 2253 - protein, 25 aa, Artificial
  Consensus peptide
RSPLGDRLNVEVDAAPTVDLNRVLN

SEQ ID NO: 2254 - protein, 25 aa, Artificial
  Consensus peptide
RCQLGDRLNVEVDTAPTVDLNRVLN

SEQ ID NO: 2255 - protein, 25 aa, Artificial
  Consensus peptide
RSQLGDRLNVEVDTAPTVDLNRVLN

SEQ ID NO: 2256 - protein, 25 aa, Artificial
  Consensus peptide
RCPLGDRLNVEVDTAPTVDLNRVLN

SEQ ID NO: 2257 - protein, 25 aa, Artificial
  Consensus peptide
RSPLGDRLNVEVDTAPTVDLNRVLN

SEQ ID NO: 2258 - protein, 25 aa, Artificial
  Consensus peptide
CQLGDRLNVEVDAAPTVDLNQVLNE

SEQ ID NO: 2259 - protein, 25 aa, Artificial
  Consensus peptide
SQLGDRLNVEVDAAPTVDLNQVLNE

SEQ ID NO: 2260 - protein, 25 aa, Artificial
  Consensus peptide
CPLGDRLNVEVDAAPTVDLNQVLNE

SEQ ID NO: 2261 - protein, 25 aa, Artificial
  Consensus peptide
SPLGDRLNVEVDAAPTVDLNQVLNE

SEQ ID NO: 2262 - protein, 25 aa, Artificial
  Consensus peptide
CQLGDRLNVEVDTAPTVDLNQVLNE

SEQ ID NO: 2263 - protein, 25 aa, Artificial
  Consensus peptide
SQLGDRLNVEVDTAPTVDLNQVLNE

SEQ ID NO: 2264 - protein, 25 aa, Artificial
  Consensus peptide
CPLGDRLNVEVDTAPTVDLNQVLNE

SEQ ID NO: 2265 - protein, 25 aa, Artificial
  Consensus peptide
SPLGDRLNVEVDTAPTVDLNQVLNE

SEQ ID NO: 2266 - protein, 25 aa, Artificial
  Consensus peptide
CQLGDRLNVEVDAAPTVDLNRVLNE

SEQ ID NO: 2267 - protein, 25 aa, Artificial
  Consensus peptide
SQLGDRLNVEVDAAPTVDLNRVLNE

SEQ ID NO: 2268 - protein, 25 aa, Artificial
  Consensus peptide
CPLGDRLNVEVDAAPTVDLNRVLNE

SEQ ID NO: 2269 - protein, 25 aa, Artificial
  Consensus peptide
SPLGDRLNVEVDAAPTVDLNRVLNE

SEQ ID NO: 2270 - protein, 25 aa, Artificial
  Consensus peptide
CQLGDRLNVEVDTAPTVDLNRVLNE

SEQ ID NO: 2271 - protein, 25 aa, Artificial
  Consensus peptide
SQLGDRLNVEVDTAPTVDLNRVLNE

SEQ ID NO: 2272 - protein, 25 aa, Artificial
  Consensus peptide
CPLGDRLNVEVDTAPTVDLNRVLNE

SEQ ID NO: 2273 - protein, 25 aa, Artificial
  Consensus peptide
SPLGDRLNVEVDTAPTVDLNRVLNE

SEQ ID NO: 2274 - protein, 25 aa, Artificial
  Consensus peptide
QLGDRLNVEVDAAPTVDLNQVLNET

SEQ ID NO: 2275 - protein, 25 aa, Artificial
  Consensus peptide
PLGDRLNVEVDAAPTVDLNQVLNET

SEQ ID NO: 2276 - protein, 25 aa, Artificial
  Consensus peptide
QLGDRLNVEVDTAPTVDLNQVLNET

SEQ ID NO: 2277 - protein, 25 aa, Artificial
  Consensus peptide
PLGDRLNVEVDTAPTVDLNQVLNET

SEQ ID NO: 2278 - protein, 25 aa, Artificial
  Consensus peptide
QLGDRLNVEVDAAPTVDLNRVLNET

SEQ ID NO: 2279 - protein, 25 aa, Artificial
  Consensus peptide
PLGDRLNVEVDAAPTVDLNRVLNET

SEQ ID NO: 2280 - protein, 25 aa, Artificial
  Consensus peptide
QLGDRLNVEVDTAPTVDLNRVLNET

SEQ ID NO: 2281 - protein, 25 aa, Artificial
  Consensus peptide
PLGDRLNVEVDTAPTVDLNRVLNET

SEQ ID NO: 2282 - protein, 25 aa, Artificial
  Consensus peptide
LGDRLNVEVDAAPTVDLNQVLNETR

SEQ ID NO: 2283 - protein, 25 aa, Artificial
  Consensus peptide
LGDRLNVEVDAAPTVDLNRVLNETR

SEQ ID NO: 2284 - protein, 25 aa, Artificial
  Consensus peptide
LGDRLNVEVDTAPTVDLNQVLNETR

SEQ ID NO: 2285 - protein, 25 aa, Artificial
  Consensus peptide
LGDRLNVEVDTAPTVDLNRVLNETR

SEQ ID NO: 2286 - protein, 25 aa, Artificial
  Consensus peptide
GDRLNVEVDAAPTVDLNQVLNETRS

SEQ ID NO: 2287 - protein, 25 aa, Artificial
  Consensus peptide
GDRLNVEVDTAPTVDLNQVLNETRS

SEQ ID NO: 2288 - protein, 25 aa, Artificial
  Consensus peptide
GDRLNVEVDAAPTVDLNRVLNETRS

SEQ ID NO: 2289 - protein, 25 aa, Artificial
  Consensus peptide
GDRLNVEVDTAPTVDLNRVLNETRS

SEQ ID NO: 2290 - protein, 25 aa, Artificial
  Consensus peptide
GDRLNVEVDAAPTVDLNQVLNETRN

SEQ ID NO: 2291 - protein, 25 aa, Artificial
  Consensus peptide
GDRLNVEVDTAPTVDLNQVLNETRN

SEQ ID NO: 2292 - protein, 25 aa, Artificial
  Consensus peptide
GDRLNVEVDAAPTVDLNRVLNETRN

SEQ ID NO: 2293 - protein, 25 aa, Artificial
  Consensus peptide
GDRLNVEVDTAPTVDLNRVLNETRN

SEQ ID NO: 2294 - protein, 25 aa, Artificial
  Consensus peptide
DRLNVEVDAAPTVDLNQVLNETRSQ

SEQ ID NO: 2295 - protein, 25 aa, Artificial
  Consensus peptide
DRLNVEVDTAPTVDLNQVLNETRSQ

SEQ ID NO: 2296 - protein, 25 aa, Artificial
  Consensus peptide
DRLNVEVDAAPTVDLNRVLNETRSQ

SEQ ID NO: 2297 - protein, 25 aa, Artificial
  Consensus peptide
DRLNVEVDTAPTVDLNRVLNETRSQ

SEQ ID NO: 2298 - protein, 25 aa, Artificial
  Consensus peptide
DRLNVEVDAAPTVDLNQVLNETRNQ

SEQ ID NO: 2299 - protein, 25 aa, Artificial
  Consensus peptide
DRLNVEVDTAPTVDLNQVLNETRNQ

SEQ ID NO: 2300 - protein, 25 aa, Artificial
  Consensus peptide
DRLNVEVDAAPTVDLNRVLNETRNQ

SEQ ID NO: 2301 - protein, 25 aa, Artificial
  Consensus peptide
DRLNVEVDTAPTVDLNRVLNETRNQ

SEQ ID NO: 2302 - protein, 25 aa, Artificial
  Consensus peptide
RLNVEVDAAPTVDLNQVLNETRSQY

SEQ ID NO: 2303 - protein, 25 aa, Artificial
  Consensus peptide
RLNVEVDTAPTVDLNQVLNETRSQY

SEQ ID NO: 2304 - protein, 25 aa, Artificial
  Consensus peptide
RLNVEVDAAPTVDLNRVLNETRSQY

SEQ ID NO: 2305 - protein, 25 aa, Artificial
  Consensus peptide
RLNVEVDTAPTVDLNRVLNETRSQY

SEQ ID NO: 2306 - protein, 25 aa, Artificial
  Consensus peptide
RLNVEVDAAPTVDLNQVLNETRNQY

SEQ ID NO: 2307 - protein, 25 aa, Artificial
  Consensus peptide
RLNVEVDTAPTVDLNQVLNETRNQY

SEQ ID NO: 2308 - protein, 25 aa, Artificial
  Consensus peptide
RLNVEVDAAPTVDLNRVLNETRNQY

SEQ ID NO: 2309 - protein, 25 aa, Artificial
  Consensus peptide
RLNVEVDTAPTVDLNRVLNETRNQY

SEQ ID NO: 2310 - protein, 25 aa, Artificial
  Consensus peptide
LNVEVDAAPTVDLNQVLNETRSQYE

SEQ ID NO: 2311 - protein, 25 aa, Artificial
  Consensus peptide
LNVEVDTAPTVDLNQVLNETRSQYE

SEQ ID NO: 2312 - protein, 25 aa, Artificial
  Consensus peptide
LNVEVDAAPTVDLNRVLNETRSQYE

SEQ ID NO: 2313 - protein, 25 aa, Artificial
  Consensus peptide
LNVEVDTAPTVDLNRVLNETRSQYE

SEQ ID NO: 2314 - protein, 25 aa, Artificial
  Consensus peptide
LNVEVDAAPTVDLNQVLNETRNQYE

SEQ ID NO: 2315 - protein, 25 aa, Artificial
  Consensus peptide
LNVEVDTAPTVDLNQVLNETRNQYE

SEQ ID NO: 2316 - protein, 25 aa, Artificial
  Consensus peptide
LNVEVDAAPTVDLNRVLNETRNQYE

SEQ ID NO: 2317 - protein, 25 aa, Artificial
  Consensus peptide
LNVEVDTAPTVDLNRVLNETRNQYE

SEQ ID NO: 2318 - protein, 25 aa, Artificial
  Consensus peptide
NVEVDAAPTVDLNQVLNETRSQYEA

SEQ ID NO: 2319 - protein, 25 aa, Artificial
  Consensus peptide
NVEVDTAPTVDLNQVLNETRSQYEA

SEQ ID NO: 2320 - protein, 25 aa, Artificial
  Consensus peptide
NVEVDAAPTVDLNRVLNETRSQYEA

SEQ ID NO: 2321 - protein, 25 aa, Artificial
  Consensus peptide
NVEVDTAPTVDLNRVLNETRSQYEA

SEQ ID NO: 2322 - protein, 25 aa, Artificial
  Consensus peptide
NVEVDAAPTVDLNQVLNETRNQYEA

SEQ ID NO: 2323 - protein, 25 aa, Artificial
  Consensus peptide
NVEVDTAPTVDLNQVLNETRNQYEA

SEQ ID NO: 2324 - protein, 25 aa, Artificial
  Consensus peptide
NVEVDAAPTVDLNRVLNETRNQYEA

SEQ ID NO: 2325 - protein, 25 aa, Artificial
  Consensus peptide
NVEVDTAPTVDLNRVLNETRNQYEA

SEQ ID NO: 2326 - protein, 25 aa, Artificial
  Consensus peptide
VEVDAAPTVDLNQVLNETRSQYEAL

SEQ ID NO: 2327 - protein, 25 aa, Artificial
  Consensus peptide
VEVDTAPTVDLNQVLNETRSQYEAL

SEQ ID NO: 2328 - protein, 25 aa, Artificial
  Consensus peptide
VEVDAAPTVDLNRVLNETRSQYEAL

SEQ ID NO: 2329 - protein, 25 aa, Artificial
  Consensus peptide
VEVDTAPTVDLNRVLNETRSQYEAL

SEQ ID NO: 2330 - protein, 25 aa, Artificial
  Consensus peptide
VEVDAAPTVDLNQVLNETRNQYEAL

SEQ ID NO: 2331 - protein, 25 aa, Artificial
  Consensus peptide
VEVDTAPTVDLNQVLNETRNQYEAL

SEQ ID NO: 2332 - protein, 25 aa, Artificial
  Consensus peptide
VEVDAAPTVDLNRVLNETRNQYEAL

SEQ ID NO: 2333 - protein, 25 aa, Artificial
  Consensus peptide
VEVDTAPTVDLNRVLNETRNQYEAL

SEQ ID NO: 2334 - protein, 26 aa, Artificial
  Consensus peptide
EVNTLRCQLGDRLNVEVDAAPTVDLN

SEQ ID NO: 2335 - protein, 26 aa, Artificial
  Consensus peptide
EVNTLRSQLGDRLNVEVDAAPTVDLN

SEQ ID NO: 2336 - protein, 26 aa, Artificial
  Consensus peptide
EVNTLRCPLGDRLNVEVDAAPTVDLN

SEQ ID NO: 2337 - protein, 26 aa, Artificial
  Consensus peptide
EVNTLRSPLGDRLNVEVDAAPTVDLN

SEQ ID NO: 2338 - protein, 26 aa, Artificial
  Consensus peptide
EVNTLRCQLGDRLNVEVDTAPTVDLN

SEQ ID NO: 2339 - protein, 26 aa, Artificial
  Consensus peptide
EVNTLRSQLGDRLNVEVDTAPTVDLN

SEQ ID NO: 2340 - protein, 26 aa, Artificial
  Consensus peptide
EVNTLRCPLGDRLNVEVDTAPTVDLN

SEQ ID NO: 2341 - protein, 26 aa, Artificial
  Consensus peptide
EVNTLRSPLGDRLNVEVDTAPTVDLN

SEQ ID NO: 2342 - protein, 26 aa, Artificial
  Consensus peptide
VNTLRCQLGDRLNVEVDAAPTVDLNQ

SEQ ID NO: 2343 - protein, 26 aa, Artificial
  Consensus peptide
VNTLRSQLGDRLNVEVDAAPTVDLNQ

SEQ ID NO: 2344 - protein, 26 aa, Artificial
  Consensus peptide
VNTLRCPLGDRLNVEVDAAPTVDLNQ

SEQ ID NO: 2345 - protein, 26 aa, Artificial
  Consensus peptide
VNTLRSPLGDRLNVEVDAAPTVDLNQ

SEQ ID NO: 2346 - protein, 26 aa, Artificial
  Consensus peptide
VNTLRCQLGDRLNVEVDTAPTVDLNQ

SEQ ID NO: 2347 - protein, 26 aa, Artificial
  Consensus peptide
VNTLRSQLGDRLNVEVDTAPTVDLNQ

SEQ ID NO: 2348 - protein, 26 aa, Artificial
  Consensus peptide
VNTLRCPLGDRLNVEVDTAPTVDLNQ

SEQ ID NO: 2349 - protein, 26 aa, Artificial
  Consensus peptide
VNTLRSPLGDRLNVEVDTAPTVDLNQ

SEQ ID NO: 2350 - protein, 26 aa, Artificial
  Consensus peptide
VNTLRCQLGDRLNVEVDAAPTVDLNR

SEQ ID NO: 2351 - protein, 26 aa, Artificial
  Consensus peptide
VNTLRSQLGDRLNVEVDAAPTVDLNR

SEQ ID NO: 2352 - protein, 26 aa, Artificial
  Consensus peptide
VNTLRCPLGDRLNVEVDAAPTVDLNR

SEQ ID NO: 2353 - protein, 26 aa, Artificial
  Consensus peptide
VNTLRSPLGDRLNVEVDAAPTVDLNR

SEQ ID NO: 2354 - protein, 26 aa, Artificial
  Consensus peptide
VNTLRCQLGDRLNVEVDTAPTVDLNR

SEQ ID NO: 2355 - protein, 26 aa, Artificial
  Consensus peptide
VNTLRSQLGDRLNVEVDTAPTVDLNR

SEQ ID NO: 2356 - protein, 26 aa, Artificial
  Consensus peptide
VNTLRCPLGDRLNVEVDTAPTVDLNR

SEQ ID NO: 2357 - protein, 26 aa, Artificial
  Consensus peptide
VNTLRSPLGDRLNVEVDTAPTVDLNR

SEQ ID NO: 2358 - protein, 26 aa, Artificial
  Consensus peptide
NTLRCQLGDRLNVEVDAAPTVDLNQV

SEQ ID NO: 2359 - protein, 26 aa, Artificial
  Consensus peptide
NTLRSQLGDRLNVEVDAAPTVDLNQV

SEQ ID NO: 2360 - protein, 26 aa, Artificial
  Consensus peptide
NTLRCPLGDRLNVEVDAAPTVDLNQV

SEQ ID NO: 2361 - protein, 26 aa, Artificial
  Consensus peptide
NTLRSPLGDRLNVEVDAAPTVDLNQV

SEQ ID NO: 2362 - protein, 26 aa, Artificial
  Consensus peptide
NTLRCQLGDRLNVEVDTAPTVDLNQV

SEQ ID NO: 2363 - protein, 26 aa, Artificial
  Consensus peptide
NTLRSQLGDRLNVEVDTAPTVDLNQV

SEQ ID NO: 2364 - protein, 26 aa, Artificial
  Consensus peptide
NTLRCPLGDRLNVEVDTAPTVDLNQV

SEQ ID NO: 2365 - protein, 26 aa, Artificial
  Consensus peptide
NTLRSPLGDRLNVEVDTAPTVDLNQV

SEQ ID NO: 2366 - protein, 26 aa, Artificial
  Consensus peptide
NTLRCQLGDRLNVEVDAAPTVDLNRV

SEQ ID NO: 2367 - protein, 26 aa, Artificial
  Consensus peptide
NTLRSQLGDRLNVEVDAAPTVDLNRV

SEQ ID NO: 2368 - protein, 26 aa, Artificial
  Consensus peptide
NTLRCPLGDRLNVEVDAAPTVDLNRV

SEQ ID NO: 2369 - protein, 26 aa, Artificial
  Consensus peptide
NTLRSPLGDRLNVEVDAAPTVDLNRV

SEQ ID NO: 2370 - protein, 26 aa, Artificial
  Consensus peptide
NTLRCQLGDRLNVEVDTAPTVDLNRV

SEQ ID NO: 2371 - protein, 26 aa, Artificial
  Consensus peptide
NTLRSQLGDRLNVEVDTAPTVDLNRV

SEQ ID NO: 2372 - protein, 26 aa, Artificial
  Consensus peptide
NTLRCPLGDRLNVEVDTAPTVDLNRV

SEQ ID NO: 2373 - protein, 26 aa, Artificial
  Consensus peptide
NTLRSPLGDRLNVEVDTAPTVDLNRV

SEQ ID NO: 2374 - protein, 26 aa, Artificial
  Consensus peptide
TLRCQLGDRLNVEVDAAPTVDLNQVL

SEQ ID NO: 2375 - protein, 26 aa, Artificial
  Consensus peptide
TLRSQLGDRLNVEVDAAPTVDLNQVL

SEQ ID NO: 2376 - protein, 26 aa, Artificial
  Consensus peptide
TLRCPLGDRLNVEVDAAPTVDLNQVL

SEQ ID NO: 2377 - protein, 26 aa, Artificial
  Consensus peptide
TLRSPLGDRLNVEVDAAPTVDLNQVL

SEQ ID NO: 2378 - protein, 26 aa, Artificial
  Consensus peptide
TLRCQLGDRLNVEVDTAPTVDLNQVL

SEQ ID NO: 2379 - protein, 26 aa, Artificial
  Consensus peptide
TLRSQLGDRLNVEVDTAPTVDLNQVL

SEQ ID NO: 2380 - protein, 26 aa, Artificial
  Consensus peptide
TLRCPLGDRLNVEVDTAPTVDLNQVL

SEQ ID NO: 2381 - protein, 26 aa, Artificial
  Consensus peptide
TLRSPLGDRLNVEVDTAPTVDLNQVL

SEQ ID NO: 2382 - protein, 26 aa, Artificial
  Consensus peptide
TLRCQLGDRLNVEVDAAPTVDLNRVL

SEQ ID NO: 2383 - protein, 26 aa, Artificial
  Consensus peptide
TLRSQLGDRLNVEVDAAPTVDLNRVL

SEQ ID NO: 2384 - protein, 26 aa, Artificial
  Consensus peptide
TLRCPLGDRLNVEVDAAPTVDLNRVL

SEQ ID NO: 2385 - protein, 26 aa, Artificial
  Consensus peptide
TLRSPLGDRLNVEVDAAPTVDLNRVL

SEQ ID NO: 2386 - protein, 26 aa, Artificial
  Consensus peptide
TLRCQLGDRLNVEVDTAPTVDLNRVL

SEQ ID NO: 2387 - protein, 26 aa, Artificial
  Consensus peptide
TLRSQLGDRLNVEVDTAPTVDLNRVL

SEQ ID NO: 2388 - protein, 26 aa, Artificial
  Consensus peptide
TLRCPLGDRLNVEVDTAPTVDLNRVL

SEQ ID NO: 2389 - protein, 26 aa, Artificial
  Consensus peptide
TLRSPLGDRLNVEVDTAPTVDLNRVL

SEQ ID NO: 2390 - protein, 26 aa, Artificial
  Consensus peptide
LRCQLGDRLNVEVDAAPTVDLNQVLN

SEQ ID NO: 2391 - protein, 26 aa, Artificial
  Consensus peptide
LRSQLGDRLNVEVDAAPTVDLNQVLN

SEQ ID NO: 2392 - protein, 26 aa, Artificial
  Consensus peptide
LRCPLGDRLNVEVDAAPTVDLNQVLN

SEQ ID NO: 2393 - protein, 26 aa, Artificial
  Consensus peptide
LRSPLGDRLNVEVDAAPTVDLNQVLN

SEQ ID NO: 2394 - protein, 26 aa, Artificial
  Consensus peptide
LRCQLGDRLNVEVDTAPTVDLNQVLN

SEQ ID NO: 2395 - protein, 26 aa, Artificial
  Consensus peptide
LRSQLGDRLNVEVDTAPTVDLNQVLN

SEQ ID NO: 2396 - protein, 26 aa, Artificial
  Consensus peptide
LRCPLGDRLNVEVDTAPTVDLNQVLN

SEQ ID NO: 2397 - protein, 26 aa, Artificial
  Consensus peptide
LRSPLGDRLNVEVDTAPTVDLNQVLN

SEQ ID NO: 2398 - protein, 26 aa, Artificial
  Consensus peptide
LRCQLGDRLNVEVDAAPTVDLNRVLN

SEQ ID NO: 2399 - protein, 26 aa, Artificial
  Consensus peptide
LRSQLGDRLNVEVDAAPTVDLNRVLN

SEQ ID NO: 2400 - protein, 26 aa, Artificial
  Consensus peptide
LRCPLGDRLNVEVDAAPTVDLNRVLN

SEQ ID NO: 2401 - protein, 26 aa, Artificial
  Consensus peptide
LRSPLGDRLNVEVDAAPTVDLNRVLN

SEQ ID NO: 2402 - protein, 26 aa, Artificial
  Consensus peptide
LRCQLGDRLNVEVDTAPTVDLNRVLN

SEQ ID NO: 2403 - protein, 26 aa, Artificial
  Consensus peptide
LRSQLGDRLNVEVDTAPTVDLNRVLN

SEQ ID NO: 2404 - protein, 26 aa, Artificial
  Consensus peptide
LRCPLGDRLNVEVDTAPTVDLNRVLN

SEQ ID NO: 2405 - protein, 26 aa, Artificial
  Consensus peptide
LRSPLGDRLNVEVDTAPTVDLNRVLN

SEQ ID NO: 2406 - protein, 26 aa, Artificial
  Consensus peptide
RCQLGDRLNVEVDAAPTVDLNQVLNE

SEQ ID NO: 2407 - protein, 26 aa, Artificial
  Consensus peptide
RSQLGDRLNVEVDAAPTVDLNQVLNE

SEQ ID NO: 2408 - protein, 26 aa, Artificial
  Consensus peptide
RCPLGDRLNVEVDAAPTVDLNQVLNE

SEQ ID NO: 2409 - protein, 26 aa, Artificial
  Consensus peptide
RSPLGDRLNVEVDAAPTVDLNQVLNE

SEQ ID NO: 2410 - protein, 26 aa, Artificial
  Consensus peptide
RCQLGDRLNVEVDTAPTVDLNQVLNE

SEQ ID NO: 2411 - protein, 26 aa, Artificial
  Consensus peptide
RSQLGDRLNVEVDTAPTVDLNQVLNE

SEQ ID NO: 2412 - protein, 26 aa, Artificial
  Consensus peptide
RCPLGDRLNVEVDTAPTVDLNQVLNE

SEQ ID NO: 2413 - protein, 26 aa, Artificial
  Consensus peptide
RSPLGDRLNVEVDTAPTVDLNQVLNE

SEQ ID NO: 2414 - protein, 26 aa, Artificial
  Consensus peptide
RCQLGDRLNVEVDAAPTVDLNRVLNE

SEQ ID NO: 2415 - protein, 26 aa, Artificial
  Consensus peptide
RSQLGDRLNVEVDAAPTVDLNRVLNE

SEQ ID NO: 2416 - protein, 26 aa, Artificial
  Consensus peptide
RCPLGDRLNVEVDAAPTVDLNRVLNE

SEQ ID NO: 2417 - protein, 26 aa, Artificial
  Consensus peptide
RSPLGDRLNVEVDAAPTVDLNRVLNE

SEQ ID NO: 2418 - protein, 26 aa, Artificial
  Consensus peptide
RCQLGDRLNVEVDTAPTVDLNRVLNE

SEQ ID NO: 2419 - protein, 26 aa, Artificial
  Consensus peptide
RSQLGDRLNVEVDTAPTVDLNRVLNE

SEQ ID NO: 2420 - protein, 26 aa, Artificial
  Consensus peptide
RCPLGDRLNVEVDTAPTVDLNRVLNE

SEQ ID NO: 2421 - protein, 26 aa, Artificial
  Consensus peptide
RSPLGDRLNVEVDTAPTVDLNRVLNE

SEQ ID NO: 2422 - protein, 26 aa, Artificial
  Consensus peptide
CQLGDRLNVEVDAAPTVDLNQVLNET

SEQ ID NO: 2423 - protein, 26 aa, Artificial
  Consensus peptide
SQLGDRLNVEVDAAPTVDLNQVLNET

SEQ ID NO: 2424 - protein, 26 aa, Artificial
  Consensus peptide
CPLGDRLNVEVDAAPTVDLNQVLNET

SEQ ID NO: 2425 - protein, 26 aa, Artificial
  Consensus peptide
SPLGDRLNVEVDAAPTVDLNQVLNET

SEQ ID NO: 2426 - protein, 26 aa, Artificial
  Consensus peptide
CQLGDRLNVEVDTAPTVDLNQVLNET

SEQ ID NO: 2427 - protein, 26 aa, Artificial
  Consensus peptide
SQLGDRLNVEVDTAPTVDLNQVLNET

SEQ ID NO: 2428 - protein, 26 aa, Artificial
  Consensus peptide
CPLGDRLNVEVDTAPTVDLNQVLNET

SEQ ID NO: 2429 - protein, 26 aa, Artificial
  Consensus peptide
SPLGDRLNVEVDTAPTVDLNQVLNET

SEQ ID NO: 2430 - protein, 26 aa, Artificial
  Consensus peptide
CQLGDRLNVEVDAAPTVDLNRVLNET

SEQ ID NO: 2431 - protein, 26 aa, Artificial
  Consensus peptide
SQLGDRLNVEVDAAPTVDLNRVLNET

SEQ ID NO: 2432 - protein, 26 aa, Artificial
  Consensus peptide
CPLGDRLNVEVDAAPTVDLNRVLNET

SEQ ID NO: 2433 - protein, 26 aa, Artificial
  Consensus peptide
SPLGDRLNVEVDAAPTVDLNRVLNET

SEQ ID NO: 2434 - protein, 26 aa, Artificial
  Consensus peptide
CQLGDRLNVEVDTAPTVDLNRVLNET

SEQ ID NO: 2435 - protein, 26 aa, Artificial
  Consensus peptide
SQLGDRLNVEVDTAPTVDLNRVLNET

SEQ ID NO: 2436 - protein, 26 aa, Artificial
  Consensus peptide
CPLGDRLNVEVDTAPTVDLNRVLNET

SEQ ID NO: 2437 - protein, 26 aa, Artificial
  Consensus peptide
SPLGDRLNVEVDTAPTVDLNRVLNET

SEQ ID NO: 2438 - protein, 26 aa, Artificial
  Consensus peptide
QLGDRLNVEVDAAPTVDLNQVLNETR

SEQ ID NO: 2439 - protein, 26 aa, Artificial
  Consensus peptide
PLGDRLNVEVDAAPTVDLNQVLNETR

SEQ ID NO: 2440 - protein, 26 aa, Artificial
  Consensus peptide
QLGDRLNVEVDTAPTVDLNQVLNETR

SEQ ID NO: 2441 - protein, 26 aa, Artificial
  Consensus peptide
PLGDRLNVEVDTAPTVDLNQVLNETR

SEQ ID NO: 2442 - protein, 26 aa, Artificial
  Consensus peptide
QLGDRLNVEVDAAPTVDLNRVLNETR

SEQ ID NO: 2443 - protein, 26 aa, Artificial
  Consensus peptide
PLGDRLNVEVDAAPTVDLNRVLNETR

SEQ ID NO: 2444 - protein, 26 aa, Artificial
  Consensus peptide
QLGDRLNVEVDTAPTVDLNRVLNETR

SEQ ID NO: 2445 - protein, 26 aa, Artificial
  Consensus peptide
PLGDRLNVEVDTAPTVDLNRVLNETR

SEQ ID NO: 2446 - protein, 26 aa, Artificial
  Consensus peptide
LGDRLNVEVDAAPTVDLNQVLNETRS

SEQ ID NO: 2447 - protein, 26 aa, Artificial
  Consensus peptide
LGDRLNVEVDTAPTVDLNQVLNETRS

SEQ ID NO: 2448 - protein, 26 aa, Artificial
  Consensus peptide
LGDRLNVEVDAAPTVDLNRVLNETRS

SEQ ID NO: 2449 - protein, 26 aa, Artificial
  Consensus peptide
LGDRLNVEVDTAPTVDLNRVLNETRS

SEQ ID NO: 2450 - protein, 26 aa, Artificial
  Consensus peptide
LGDRLNVEVDAAPTVDLNQVLNETRN

SEQ ID NO: 2451 - protein, 26 aa, Artificial
  Consensus peptide
LGDRLNVEVDTAPTVDLNQVLNETRN

SEQ ID NO: 2452 - protein, 26 aa, Artificial
  Consensus peptide
LGDRLNVEVDAAPTVDLNRVLNETRN

SEQ ID NO: 2453 - protein, 26 aa, Artificial
  Consensus peptide
LGDRLNVEVDTAPTVDLNRVLNETRN

SEQ ID NO: 2454 - protein, 26 aa, Artificial
  Consensus peptide
GDRLNVEVDAAPTVDLNQVLNETRSQ

SEQ ID NO: 2455 - protein, 26 aa, Artificial
  Consensus peptide
GDRLNVEVDTAPTVDLNQVLNETRSQ

SEQ ID NO: 2456 - protein, 26 aa, Artificial
  Consensus peptide
GDRLNVEVDAAPTVDLNRVLNETRSQ

SEQ ID NO: 2457 - protein, 26 aa, Artificial
  Consensus peptide
GDRLNVEVDTAPTVDLNRVLNETRSQ

SEQ ID NO: 2458 - protein, 26 aa, Artificial
  Consensus peptide
GDRLNVEVDAAPTVDLNQVLNETRNQ

SEQ ID NO: 2459 - protein, 26 aa, Artificial
  Consensus peptide
GDRLNVEVDTAPTVDLNQVLNETRNQ

SEQ ID NO: 2460 - protein, 26 aa, Artificial
  Consensus peptide
GDRLNVEVDAAPTVDLNRVLNETRNQ

SEQ ID NO: 2461 - protein, 26 aa, Artificial
  Consensus peptide
GDRLNVEVDTAPTVDLNRVLNETRNQ

SEQ ID NO: 2462 - protein, 26 aa, Artificial
  Consensus peptide
DRLNVEVDAAPTVDLNQVLNETRSQY

SEQ ID NO: 2463 - protein, 26 aa, Artificial
  Consensus peptide
DRLNVEVDTAPTVDLNQVLNETRSQY

SEQ ID NO: 2464 - protein, 26 aa, Artificial
  Consensus peptide
DRLNVEVDAAPTVDLNRVLNETRSQY

SEQ ID NO: 2465 - protein, 26 aa, Artificial
  Consensus peptide
DRLNVEVDTAPTVDLNRVLNETRSQY

SEQ ID NO: 2466 - protein, 26 aa, Artificial
  Consensus peptide
DRLNVEVDAAPTVDLNQVLNETRNQY

SEQ ID NO: 2467 - protein, 26 aa, Artificial
  Consensus peptide
DRLNVEVDTAPTVDLNQVLNETRNQY

SEQ ID NO: 2468 - protein, 26 aa, Artificial
  Consensus peptide
DRLNVEVDAAPTVDLNRVLNETRNQY

SEQ ID NO: 2469 - protein, 26 aa, Artificial
  Consensus peptide
DRLNVEVDTAPTVDLNRVLNETRNQY

SEQ ID NO: 2470 - protein, 26 aa, Artificial
  Consensus peptide
RLNVEVDAAPTVDLNQVLNETRSQYE

SEQ ID NO: 2471 - protein, 26 aa, Artificial
  Consensus peptide
RLNVEVDTAPTVDLNQVLNETRSQYE

SEQ ID NO: 2472 - protein, 26 aa, Artificial
  Consensus peptide
RLNVEVDAAPTVDLNRVLNETRSQYE

SEQ ID NO: 2473 - protein, 26 aa, Artificial
  Consensus peptide
RLNVEVDTAPTVDLNRVLNETRSQYE

SEQ ID NO: 2474 - protein, 26 aa, Artificial
  Consensus peptide
RLNVEVDAAPTVDLNQVLNETRNQYE

SEQ ID NO: 2475 - protein, 26 aa, Artificial
  Consensus peptide
RLNVEVDTAPTVDLNQVLNETRNQYE

SEQ ID NO: 2476 - protein, 26 aa, Artificial
  Consensus peptide
RLNVEVDAAPTVDLNRVLNETRNQYE

SEQ ID NO: 2477 - protein, 26 aa, Artificial
  Consensus peptide
RLNVEVDTAPTVDLNRVLNETRNQYE

SEQ ID NO: 2478 - protein, 26 aa, Artificial
  Consensus peptide
LNVEVDAAPTVDLNQVLNETRSQYEA

SEQ ID NO: 2479 - protein, 26 aa, Artificial
  Consensus peptide
LNVEVDTAPTVDLNQVLNETRSQYEA

SEQ ID NO: 2480 - protein, 26 aa, Artificial
  Consensus peptide
LNVEVDAAPTVDLNRVLNETRSQYEA

SEQ ID NO: 2481 - protein, 26 aa, Artificial
  Consensus peptide
LNVEVDTAPTVDLNRVLNETRSQYEA

SEQ ID NO: 2482 - protein, 26 aa, Artificial
  Consensus peptide
LNVEVDAAPTVDLNQVLNETRNQYEA

SEQ ID NO: 2483 - protein, 26 aa, Artificial
  Consensus peptide
LNVEVDTAPTVDLNQVLNETRNQYEA

SEQ ID NO: 2484 - protein, 26 aa, Artificial
  Consensus peptide
LNVEVDAAPTVDLNRVLNETRNQYEA

SEQ ID NO: 2485 - protein, 26 aa, Artificial
  Consensus peptide
LNVEVDTAPTVDLNRVLNETRNQYEA

SEQ ID NO: 2486 - protein, 26 aa, Artificial
  Consensus peptide
NVEVDAAPTVDLNQVLNETRSQYEAL

SEQ ID NO: 2487 - protein, 26 aa, Artificial
  Consensus peptide
NVEVDTAPTVDLNQVLNETRSQYEAL

SEQ ID NO: 2488 - protein, 26 aa, Artificial
  Consensus peptide
NVEVDAAPTVDLNRVLNETRSQYEAL

SEQ ID NO: 2489 - protein, 26 aa, Artificial
  Consensus peptide
NVEVDTAPTVDLNRVLNETRSQYEAL

SEQ ID NO: 2490 - protein, 26 aa, Artificial
  Consensus peptide
NVEVDAAPTVDLNQVLNETRNQYEAL

SEQ ID NO: 2491 - protein, 26 aa, Artificial
  Consensus peptide
NVEVDTAPTVDLNQVLNETRNQYEAL

SEQ ID NO: 2492 - protein, 26 aa, Artificial
  Consensus peptide
NVEVDAAPTVDLNRVLNETRNQYEAL

SEQ ID NO: 2493 - protein, 26 aa, Artificial
  Consensus peptide
NVEVDTAPTVDLNRVLNETRNQYEAL

SEQ ID NO: 2494 - protein, 27 aa, Artificial
  Consensus peptide
EVNTLRCQLGDRLNVEVDAAPTVDLNQ

SEQ ID NO: 2495 - protein, 27 aa, Artificial
  Consensus peptide
EVNTLRSQLGDRLNVEVDAAPTVDLNQ

SEQ ID NO: 2496 - protein, 27 aa, Artificial
  Consensus peptide
EVNTLRCPLGDRLNVEVDAAPTVDLNQ

SEQ ID NO: 2497 - protein, 27 aa, Artificial
  Consensus peptide
EVNTLRSPLGDRLNVEVDAAPTVDLNQ

SEQ ID NO: 2498 - protein, 27 aa, Artificial
  Consensus peptide
EVNTLRCQLGDRLNVEVDTAPTVDLNQ

SEQ ID NO: 2499 - protein, 27 aa, Artificial
  Consensus peptide
EVNTLRSQLGDRLNVEVDTAPTVDLNQ

SEQ ID NO: 2500 - protein, 27 aa, Artificial
  Consensus peptide
EVNTLRCPLGDRLNVEVDTAPTVDLNQ

SEQ ID NO: 2501 - protein, 27 aa, Artificial
  Consensus peptide
EVNTLRSPLGDRLNVEVDTAPTVDLNQ

SEQ ID NO: 2502 - protein, 27 aa, Artificial
  Consensus peptide
EVNTLRCQLGDRLNVEVDAAPTVDLNR

SEQ ID NO: 2503 - protein, 27 aa, Artificial
  Consensus peptide
EVNTLRSQLGDRLNVEVDAAPTVDLNR

SEQ ID NO: 2504 - protein, 27 aa, Artificial
  Consensus peptide
EVNTLRCPLGDRLNVEVDAAPTVDLNR

SEQ ID NO: 2505 - protein, 27 aa, Artificial
  Consensus peptide
EVNTLRSPLGDRLNVEVDAAPTVDLNR

SEQ ID NO: 2506 - protein, 27 aa, Artificial
  Consensus peptide
EVNTLRCQLGDRLNVEVDTAPTVDLNR

SEQ ID NO: 2507 - protein, 27 aa, Artificial
  Consensus peptide
EVNTLRSQLGDRLNVEVDTAPTVDLNR

SEQ ID NO: 2508 - protein, 27 aa, Artificial
  Consensus peptide
EVNTLRCPLGDRLNVEVDTAPTVDLNR

SEQ ID NO: 2509 - protein, 27 aa, Artificial
  Consensus peptide
EVNTLRSPLGDRLNVEVDTAPTVDLNR

SEQ ID NO: 2510 - protein, 27 aa, Artificial
  Consensus peptide
VNTLRCQLGDRLNVEVDAAPTVDLNQV

SEQ ID NO: 2511 - protein, 27 aa, Artificial
  Consensus peptide
VNTLRSQLGDRLNVEVDAAPTVDLNQV

SEQ ID NO: 2512 - protein, 27 aa, Artificial
  Consensus peptide
VNTLRCPLGDRLNVEVDAAPTVDLNQV

SEQ ID NO: 2513 - protein, 27 aa, Artificial
  Consensus peptide
VNTLRSPLGDRLNVEVDAAPTVDLNQV

SEQ ID NO: 2514 - protein, 27 aa, Artificial
  Consensus peptide
VNTLRCQLGDRLNVEVDTAPTVDLNQV

SEQ ID NO: 2515 - protein, 27 aa, Artificial
  Consensus peptide
VNTLRSQLGDRLNVEVDTAPTVDLNQV

SEQ ID NO: 2516 - protein, 27 aa, Artificial
  Consensus peptide
VNTLRCPLGDRLNVEVDTAPTVDLNQV

SEQ ID NO: 2517 - protein, 27 aa, Artificial
  Consensus peptide
VNTLRSPLGDRLNVEVDTAPTVDLNQV

SEQ ID NO: 2518 - protein, 27 aa, Artificial
  Consensus peptide
VNTLRCQLGDRLNVEVDAAPTVDLNRV

SEQ ID NO: 2519 - protein, 27 aa, Artificial
  Consensus peptide
VNTLRSQLGDRLNVEVDAAPTVDLNRV

SEQ ID NO: 2520 - protein, 27 aa, Artificial
  Consensus peptide
VNTLRCPLGDRLNVEVDAAPTVDLNRV

SEQ ID NO: 2521 - protein, 27 aa, Artificial
  Consensus peptide
VNTLRSPLGDRLNVEVDAAPTVDLNRV

SEQ ID NO: 2522 - protein, 27 aa, Artificial
  Consensus peptide
VNTLRCQLGDRLNVEVDTAPTVDLNRV

SEQ ID NO: 2523 - protein, 27 aa, Artificial
  Consensus peptide
VNTLRSQLGDRLNVEVDTAPTVDLNRV

SEQ ID NO: 2524 - protein, 27 aa, Artificial
  Consensus peptide
VNTLRCPLGDRLNVEVDTAPTVDLNRV

SEQ ID NO: 2525 - protein, 27 aa, Artificial
  Consensus peptide
VNTLRSPLGDRLNVEVDTAPTVDLNRV

SEQ ID NO: 2526 - protein, 27 aa, Artificial
  Consensus peptide
NTLRCQLGDRLNVEVDAAPTVDLNQVL

SEQ ID NO: 2527 - protein, 27 aa, Artificial
  Consensus peptide
NTLRSQLGDRLNVEVDAAPTVDLNQVL

SEQ ID NO: 2528 - protein, 27 aa, Artificial
  Consensus peptide
NTLRCPLGDRLNVEVDAAPTVDLNQVL

SEQ ID NO: 2529 - protein, 27 aa, Artificial
  Consensus peptide
NTLRSPLGDRLNVEVDAAPTVDLNQVL

SEQ ID NO: 2530 - protein, 27 aa, Artificial
  Consensus peptide
NTLRCQLGDRLNVEVDTAPTVDLNQVL

SEQ ID NO: 2531 - protein, 27 aa, Artificial
  Consensus peptide
NTLRSQLGDRLNVEVDTAPTVDLNQVL

SEQ ID NO: 2532 - protein, 27 aa, Artificial
  Consensus peptide
NTLRCPLGDRLNVEVDTAPTVDLNQVL

SEQ ID NO: 2533 - protein, 27 aa, Artificial
  Consensus peptide
NTLRSPLGDRLNVEVDTAPTVDLNQVL

SEQ ID NO: 2534 - protein, 27 aa, Artificial
  Consensus peptide
NTLRCQLGDRLNVEVDAAPTVDLNRVL

SEQ ID NO: 2535 - protein, 27 aa, Artificial
  Consensus peptide
NTLRSQLGDRLNVEVDAAPTVDLNRVL

SEQ ID NO: 2536 - protein, 27 aa, Artificial
  Consensus peptide
NTLRCPLGDRLNVEVDAAPTVDLNRVL

SEQ ID NO: 2537 - protein, 27 aa, Artificial
  Consensus peptide
NTLRSPLGDRLNVEVDAAPTVDLNRVL

SEQ ID NO: 2538 - protein, 27 aa, Artificial
  Consensus peptide
NTLRCQLGDRLNVEVDTAPTVDLNRVL

SEQ ID NO: 2539 - protein, 27 aa, Artificial
  Consensus peptide
NTLRSQLGDRLNVEVDTAPTVDLNRVL

SEQ ID NO: 2540 - protein, 27 aa, Artificial
  Consensus peptide
NTLRCPLGDRLNVEVDTAPTVDLNRVL

SEQ ID NO: 2541 - protein, 27 aa, Artificial
  Consensus peptide
NTLRSPLGDRLNVEVDTAPTVDLNRVL

SEQ ID NO: 2542 - protein, 27 aa, Artificial
  Consensus peptide
TLRCQLGDRLNVEVDAAPTVDLNQVLN

SEQ ID NO: 2543 - protein, 27 aa, Artificial
  Consensus peptide
TLRSQLGDRLNVEVDAAPTVDLNQVLN

SEQ ID NO: 2544 - protein, 27 aa, Artificial
  Consensus peptide
TLRCPLGDRLNVEVDAAPTVDLNQVLN

SEQ ID NO: 2545 - protein, 27 aa, Artificial
  Consensus peptide
TLRSPLGDRLNVEVDAAPTVDLNQVLN

SEQ ID NO: 2546 - protein, 27 aa, Artificial
  Consensus peptide
TLRCQLGDRLNVEVDTAPTVDLNQVLN

SEQ ID NO: 2547 - protein, 27 aa, Artificial
  Consensus peptide
TLRSQLGDRLNVEVDTAPTVDLNQVLN

SEQ ID NO: 2548 - protein, 27 aa, Artificial
  Consensus peptide
TLRCPLGDRLNVEVDTAPTVDLNQVLN

SEQ ID NO: 2549 - protein, 27 aa, Artificial
  Consensus peptide
TLRSPLGDRLNVEVDTAPTVDLNQVLN

SEQ ID NO: 2550 - protein, 27 aa, Artificial
  Consensus peptide
TLRCQLGDRLNVEVDAAPTVDLNRVLN

SEQ ID NO: 2551 - protein, 27 aa, Artificial
  Consensus peptide
TLRSQLGDRLNVEVDAAPTVDLNRVLN

SEQ ID NO: 2552 - protein, 27 aa, Artificial
  Consensus peptide
TLRCPLGDRLNVEVDAAPTVDLNRVLN

SEQ ID NO: 2553 - protein, 27 aa, Artificial
  Consensus peptide
TLRSPLGDRLNVEVDAAPTVDLNRVLN

SEQ ID NO: 2554 - protein, 27 aa, Artificial
  Consensus peptide
TLRCQLGDRLNVEVDTAPTVDLNRVLN

SEQ ID NO: 2555 - protein, 27 aa, Artificial
  Consensus peptide
TLRSQLGDRLNVEVDTAPTVDLNRVLN

SEQ ID NO: 2556 - protein, 27 aa, Artificial
  Consensus peptide
TLRCPLGDRLNVEVDTAPTVDLNRVLN

SEQ ID NO: 2557 - protein, 27 aa, Artificial
  Consensus peptide
TLRSPLGDRLNVEVDTAPTVDLNRVLN

SEQ ID NO: 2558 - protein, 27 aa, Artificial
  Consensus peptide
LRCQLGDRLNVEVDAAPTVDLNQVLNE

SEQ ID NO: 2559 - protein, 27 aa, Artificial
  Consensus peptide
LRSQLGDRLNVEVDAAPTVDLNQVLNE

SEQ ID NO: 2560 - protein, 27 aa, Artificial
  Consensus peptide
LRCPLGDRLNVEVDAAPTVDLNQVLNE

SEQ ID NO: 2561 - protein, 27 aa, Artificial
  Consensus peptide
LRSPLGDRLNVEVDAAPTVDLNQVLNE

SEQ ID NO: 2562 - protein, 27 aa, Artificial
  Consensus peptide
LRCQLGDRLNVEVDTAPTVDLNQVLNE

SEQ ID NO: 2563 - protein, 27 aa, Artificial
  Consensus peptide
LRSQLGDRLNVEVDTAPTVDLNQVLNE

SEQ ID NO: 2564 - protein, 27 aa, Artificial
  Consensus peptide
LRCPLGDRLNVEVDTAPTVDLNQVLNE

SEQ ID NO: 2565 - protein, 27 aa, Artificial
  Consensus peptide
LRSPLGDRLNVEVDTAPTVDLNQVLNE

SEQ ID NO: 2566 - protein, 27 aa, Artificial
  Consensus peptide
LRCQLGDRLNVEVDAAPTVDLNRVLNE

SEQ ID NO: 2567 - protein, 27 aa, Artificial
  Consensus peptide
LRSQLGDRLNVEVDAAPTVDLNRVLNE

SEQ ID NO: 2568 - protein, 27 aa, Artificial
  Consensus peptide
LRCPLGDRLNVEVDAAPTVDLNRVLNE

SEQ ID NO: 2569 - protein, 27 aa, Artificial
  Consensus peptide
LRSPLGDRLNVEVDAAPTVDLNRVLNE

SEQ ID NO: 2570 - protein, 27 aa, Artificial
  Consensus peptide
LRCQLGDRLNVEVDTAPTVDLNRVLNE

SEQ ID NO: 2571 - protein, 27 aa, Artificial
  Consensus peptide
LRSQLGDRLNVEVDTAPTVDLNRVLNE

SEQ ID NO: 2572 - protein, 27 aa, Artificial
  Consensus peptide
LRCPLGDRLNVEVDTAPTVDLNRVLNE

SEQ ID NO: 2573 - protein, 27 aa, Artificial
  Consensus peptide
LRSPLGDRLNVEVDTAPTVDLNRVLNE

SEQ ID NO: 2574 - protein, 27 aa, Artificial
  Consensus peptide
RCQLGDRLNVEVDAAPTVDLNQVLNET

SEQ ID NO: 2575 - protein, 27 aa, Artificial
  Consensus peptide
RSQLGDRLNVEVDAAPTVDLNQVLNET

SEQ ID NO: 2576 - protein, 27 aa, Artificial
  Consensus peptide
RCPLGDRLNVEVDAAPTVDLNQVLNET

SEQ ID NO: 2577 - protein, 27 aa, Artificial
  Consensus peptide
RSPLGDRLNVEVDAAPTVDLNQVLNET

SEQ ID NO: 2578 - protein, 27 aa, Artificial
  Consensus peptide
RCQLGDRLNVEVDTAPTVDLNQVLNET

SEQ ID NO: 2579 - protein, 27 aa, Artificial
  Consensus peptide
RSQLGDRLNVEVDTAPTVDLNQVLNET

SEQ ID NO: 2580 - protein, 27 aa, Artificial
  Consensus peptide
RCPLGDRLNVEVDTAPTVDLNQVLNET

SEQ ID NO: 2581 - protein, 27 aa, Artificial
  Consensus peptide
RSPLGDRLNVEVDTAPTVDLNQVLNET

SEQ ID NO: 2582 - protein, 27 aa, Artificial
  Consensus peptide
RCQLGDRLNVEVDAAPTVDLNRVLNET

SEQ ID NO: 2583 - protein, 27 aa, Artificial
  Consensus peptide
RSQLGDRLNVEVDAAPTVDLNRVLNET

SEQ ID NO: 2584 - protein, 27 aa, Artificial
  Consensus peptide
RCPLGDRLNVEVDAAPTVDLNRVLNET

SEQ ID NO: 2585 - protein, 27 aa, Artificial
  Consensus peptide
RSPLGDRLNVEVDAAPTVDLNRVLNET

SEQ ID NO: 2586 - protein, 27 aa, Artificial
  Consensus peptide
RCQLGDRLNVEVDTAPTVDLNRVLNET

SEQ ID NO: 2587 - protein, 27 aa, Artificial
  Consensus peptide
RSQLGDRLNVEVDTAPTVDLNRVLNET

SEQ ID NO: 2588 - protein, 27 aa, Artificial
  Consensus peptide
RCPLGDRLNVEVDTAPTVDLNRVLNET

SEQ ID NO: 2589 - protein, 27 aa, Artificial
  Consensus peptide
RSPLGDRLNVEVDTAPTVDLNRVLNET

SEQ ID NO: 2590 - protein, 27 aa, Artificial
  Consensus peptide
CQLGDRLNVEVDAAPTVDLNQVLNETR

SEQ ID NO: 2591 - protein, 27 aa, Artificial
  Consensus peptide
SQLGDRLNVEVDAAPTVDLNQVLNETR

SEQ ID NO: 2592 - protein, 27 aa, Artificial
  Consensus peptide
CPLGDRLNVEVDAAPTVDLNQVLNETR

SEQ ID NO: 2593 - protein, 27 aa, Artificial
  Consensus peptide
SPLGDRLNVEVDAAPTVDLNQVLNETR

SEQ ID NO: 2594 - protein, 27 aa, Artificial
  Consensus peptide
CQLGDRLNVEVDTAPTVDLNQVLNETR

SEQ ID NO: 2595 - protein, 27 aa, Artificial
  Consensus peptide
SQLGDRLNVEVDTAPTVDLNQVLNETR

SEQ ID NO: 2596 - protein, 27 aa, Artificial
  Consensus peptide
CPLGDRLNVEVDTAPTVDLNQVLNETR

SEQ ID NO: 2597 - protein, 27 aa, Artificial
  Consensus peptide
SPLGDRLNVEVDTAPTVDLNQVLNETR

SEQ ID NO: 2598 - protein, 27 aa, Artificial
  Consensus peptide
CQLGDRLNVEVDAAPTVDLNRVLNETR

SEQ ID NO: 2599 - protein, 27 aa, Artificial
  Consensus peptide
SQLGDRLNVEVDAAPTVDLNRVLNETR

SEQ ID NO: 2600 - protein, 27 aa, Artificial
  Consensus peptide
CPLGDRLNVEVDAAPTVDLNRVLNETR

SEQ ID NO: 2601 - protein, 27 aa, Artificial
  Consensus peptide
SPLGDRLNVEVDAAPTVDLNRVLNETR

SEQ ID NO: 2602 - protein, 27 aa, Artificial
  Consensus peptide
CQLGDRLNVEVDTAPTVDLNRVLNETR

SEQ ID NO: 2603 - protein, 27 aa, Artificial
  Consensus peptide
SQLGDRLNVEVDTAPTVDLNRVLNETR

SEQ ID NO: 2604 - protein, 27 aa, Artificial
  Consensus peptide
CPLGDRLNVEVDTAPTVDLNRVLNETR

SEQ ID NO: 2605 - protein, 27 aa, Artificial
  Consensus peptide
SPLGDRLNVEVDTAPTVDLNRVLNETR

SEQ ID NO: 2606 - protein, 27 aa, Artificial
  Consensus peptide
QLGDRLNVEVDAAPTVDLNQVLNETRS

SEQ ID NO: 2607 - protein, 27 aa, Artificial
  Consensus peptide
PLGDRLNVEVDAAPTVDLNQVLNETRS

SEQ ID NO: 2608 - protein, 27 aa, Artificial
  Consensus peptide
QLGDRLNVEVDTAPTVDLNQVLNETRS

SEQ ID NO: 2609 - protein, 27 aa, Artificial
  Consensus peptide
PLGDRLNVEVDTAPTVDLNQVLNETRS

SEQ ID NO: 2610 - protein, 27 aa, Artificial
  Consensus peptide
QLGDRLNVEVDAAPTVDLNRVLNETRS

SEQ ID NO: 2611 - protein, 27 aa, Artificial
  Consensus peptide
PLGDRLNVEVDAAPTVDLNRVLNETRS

SEQ ID NO: 2612 - protein, 27 aa, Artificial
  Consensus peptide
QLGDRLNVEVDTAPTVDLNRVLNETRS

SEQ ID NO: 2613 - protein, 27 aa, Artificial
  Consensus peptide
PLGDRLNVEVDTAPTVDLNRVLNETRS

SEQ ID NO: 2614 - protein, 27 aa, Artificial
  Consensus peptide
QLGDRLNVEVDAAPTVDLNQVLNETRN

SEQ ID NO: 2615 - protein, 27 aa, Artificial
  Consensus peptide
PLGDRLNVEVDAAPTVDLNQVLNETRN

SEQ ID NO: 2616 - protein, 27 aa, Artificial
  Consensus peptide
QLGDRLNVEVDTAPTVDLNQVLNETRN

SEQ ID NO: 2617 - protein, 27 aa, Artificial
  Consensus peptide
PLGDRLNVEVDTAPTVDLNQVLNETRN

SEQ ID NO: 2618 - protein, 27 aa, Artificial
  Consensus peptide
QLGDRLNVEVDAAPTVDLNRVLNETRN

SEQ ID NO: 2619 - protein, 27 aa, Artificial
  Consensus peptide
PLGDRLNVEVDAAPTVDLNRVLNETRN

SEQ ID NO: 2620 - protein, 27 aa, Artificial
  Consensus peptide
QLGDRLNVEVDTAPTVDLNRVLNETRN

SEQ ID NO: 2621 - protein, 27 aa, Artificial
  Consensus peptide
PLGDRLNVEVDTAPTVDLNRVLNETRN

SEQ ID NO: 2622 - protein, 27 aa, Artificial
  Consensus peptide
LGDRLNVEVDAAPTVDLNQVLNETRSQ

SEQ ID NO: 2623 - protein, 27 aa, Artificial
  Consensus peptide
LGDRLNVEVDTAPTVDLNQVLNETRSQ

SEQ ID NO: 2624 - protein, 27 aa, Artificial
  Consensus peptide
LGDRLNVEVDAAPTVDLNRVLNETRSQ

SEQ ID NO: 2625 - protein, 27 aa, Artificial
  Consensus peptide
LGDRLNVEVDTAPTVDLNRVLNETRSQ

SEQ ID NO: 2626 - protein, 27 aa, Artificial
  Consensus peptide
LGDRLNVEVDAAPTVDLNQVLNETRNQ

SEQ ID NO: 2627 - protein, 27 aa, Artificial
  Consensus peptide
LGDRLNVEVDTAPTVDLNQVLNETRNQ

SEQ ID NO: 2628 - protein, 27 aa, Artificial
  Consensus peptide
LGDRLNVEVDAAPTVDLNRVLNETRNQ

SEQ ID NO: 2629 - protein, 27 aa, Artificial
  Consensus peptide
LGDRLNVEVDTAPTVDLNRVLNETRNQ

SEQ ID NO: 2630 - protein, 27 aa, Artificial
  Consensus peptide
GDRLNVEVDAAPTVDLNQVLNETRSQY

SEQ ID NO: 2631 - protein, 27 aa, Artificial
  Consensus peptide
GDRLNVEVDTAPTVDLNQVLNETRSQY

SEQ ID NO: 2632 - protein, 27 aa, Artificial
  Consensus peptide
GDRLNVEVDAAPTVDLNRVLNETRSQY

SEQ ID NO: 2633 - protein, 27 aa, Artificial
  Consensus peptide
GDRLNVEVDTAPTVDLNRVLNETRSQY

SEQ ID NO: 2634 - protein, 27 aa, Artificial
  Consensus peptide
GDRLNVEVDAAPTVDLNQVLNETRNQY

SEQ ID NO: 2635 - protein, 27 aa, Artificial
  Consensus peptide
GDRLNVEVDTAPTVDLNQVLNETRNQY

SEQ ID NO: 2636 - protein, 27 aa, Artificial
  Consensus peptide
GDRLNVEVDAAPTVDLNRVLNETRNQY

SEQ ID NO: 2637 - protein, 27 aa, Artificial
  Consensus peptide
GDRLNVEVDTAPTVDLNRVLNETRNQY

SEQ ID NO: 2638 - protein, 27 aa, Artificial
  Consensus peptide
DRLNVEVDAAPTVDLNQVLNETRSQYE

SEQ ID NO: 2639 - protein, 27 aa, Artificial
  Consensus peptide
DRLNVEVDTAPTVDLNQVLNETRSQYE

SEQ ID NO: 2640 - protein, 27 aa, Artificial
  Consensus peptide
DRLNVEVDAAPTVDLNRVLNETRSQYE

SEQ ID NO: 2641 - protein, 27 aa, Artificial
  Consensus peptide
DRLNVEVDTAPTVDLNRVLNETRSQYE

SEQ ID NO: 2642 - protein, 27 aa, Artificial
  Consensus peptide
DRLNVEVDAAPTVDLNQVLNETRNQYE

SEQ ID NO: 2643 - protein, 27 aa, Artificial
  Consensus peptide
DRLNVEVDTAPTVDLNQVLNETRNQYE

SEQ ID NO: 2644 - protein, 27 aa, Artificial
  Consensus peptide
DRLNVEVDAAPTVDLNRVLNETRNQYE

SEQ ID NO: 2645 - protein, 27 aa, Artificial
  Consensus peptide
DRLNVEVDTAPTVDLNRVLNETRNQYE

SEQ ID NO: 2646 - protein, 27 aa, Artificial
  Consensus peptide
RLNVEVDAAPTVDLNQVLNETRSQYEA

SEQ ID NO: 2647 - protein, 27 aa, Artificial
  Consensus peptide
RLNVEVDTAPTVDLNQVLNETRSQYEA

SEQ ID NO: 2648 - protein, 27 aa, Artificial
  Consensus peptide
RLNVEVDAAPTVDLNRVLNETRSQYEA

SEQ ID NO: 2649 - protein, 27 aa, Artificial
  Consensus peptide
RLNVEVDTAPTVDLNRVLNETRSQYEA

SEQ ID NO: 2650 - protein, 27 aa, Artificial
  Consensus peptide
RLNVEVDAAPTVDLNQVLNETRNQYEA

SEQ ID NO: 2651 - protein, 27 aa, Artificial
  Consensus peptide
RLNVEVDTAPTVDLNQVLNETRNQYEA

SEQ ID NO: 2652 - protein, 27 aa, Artificial
  Consensus peptide
RLNVEVDAAPTVDLNRVLNETRNQYEA

SEQ ID NO: 2653 - protein, 27 aa, Artificial
  Consensus peptide
RLNVEVDTAPTVDLNRVLNETRNQYEA

SEQ ID NO: 2654 - protein, 27 aa, Artificial
  Consensus peptide
LNVEVDAAPTVDLNQVLNETRSQYEAL

SEQ ID NO: 2655 - protein, 27 aa, Artificial
  Consensus peptide
LNVEVDTAPTVDLNQVLNETRSQYEAL

SEQ ID NO: 2656 - protein, 27 aa, Artificial
  Consensus peptide
LNVEVDAAPTVDLNRVLNETRSQYEAL

SEQ ID NO: 2657 - protein, 27 aa, Artificial
  Consensus peptide
LNVEVDTAPTVDLNRVLNETRSQYEAL

SEQ ID NO: 2658 - protein, 27 aa, Artificial
  Consensus peptide
LNVEVDAAPTVDLNQVLNETRNQYEAL

SEQ ID NO: 2659 - protein, 27 aa, Artificial
  Consensus peptide
LNVEVDTAPTVDLNQVLNETRNQYEAL

SEQ ID NO: 2660 - protein, 27 aa, Artificial
  Consensus peptide
LNVEVDAAPTVDLNRVLNETRNQYEAL

SEQ ID NO: 2661 - protein, 27 aa, Artificial
  Consensus peptide
LNVEVDTAPTVDLNRVLNETRNQYEAL

SEQ ID NO: 2662 - protein, 28 aa, Artificial
  Consensus peptide
EVNTLRCQLGDRLNVEVDAAPTVDLNQV

SEQ ID NO: 2663 - protein, 28 aa, Artificial
  Consensus peptide
EVNTLRSQLGDRLNVEVDAAPTVDLNQV

SEQ ID NO: 2664 - protein, 28 aa, Artificial
  Consensus peptide
EVNTLRCPLGDRLNVEVDAAPTVDLNQV

SEQ ID NO: 2665 - protein, 28 aa, Artificial
  Consensus peptide
EVNTLRSPLGDRLNVEVDAAPTVDLNQV

SEQ ID NO: 2666 - protein, 28 aa, Artificial
  Consensus peptide
EVNTLRCQLGDRLNVEVDTAPTVDLNQV

SEQ ID NO: 2667 - protein, 28 aa, Artificial
  Consensus peptide
EVNTLRSQLGDRLNVEVDTAPTVDLNQV

SEQ ID NO: 2668 - protein, 28 aa, Artificial
  Consensus peptide
EVNTLRCPLGDRLNVEVDTAPTVDLNQV

SEQ ID NO: 2669 - protein, 28 aa, Artificial
  Consensus peptide
EVNTLRSPLGDRLNVEVDTAPTVDLNQV

SEQ ID NO: 2670 - protein, 28 aa, Artificial
  Consensus peptide
EVNTLRCQLGDRLNVEVDAAPTVDLNRV

SEQ ID NO: 2671 - protein, 28 aa, Artificial
  Consensus peptide
EVNTLRSQLGDRLNVEVDAAPTVDLNRV

SEQ ID NO: 2672 - protein, 28 aa, Artificial
  Consensus peptide
EVNTLRCPLGDRLNVEVDAAPTVDLNRV

SEQ ID NO: 2673 - protein, 28 aa, Artificial
  Consensus peptide
EVNTLRSPLGDRLNVEVDAAPTVDLNRV

SEQ ID NO: 2674 - protein, 28 aa, Artificial
  Consensus peptide
EVNTLRCQLGDRLNVEVDTAPTVDLNRV

SEQ ID NO: 2675 - protein, 28 aa, Artificial
  Consensus peptide
EVNTLRSQLGDRLNVEVDTAPTVDLNRV

SEQ ID NO: 2676 - protein, 28 aa, Artificial
  Consensus peptide
EVNTLRCPLGDRLNVEVDTAPTVDLNRV

SEQ ID NO: 2677 - protein, 28 aa, Artificial
  Consensus peptide
EVNTLRSPLGDRLNVEVDTAPTVDLNRV

SEQ ID NO: 2678 - protein, 28 aa, Artificial
  Consensus peptide
VNTLRCQLGDRLNVEVDAAPTVDLNQVL

SEQ ID NO: 2679 - protein, 28 aa, Artificial
  Consensus peptide
VNTLRSQLGDRLNVEVDAAPTVDLNQVL

SEQ ID NO: 2680 - protein, 28 aa, Artificial
  Consensus peptide
VNTLRCPLGDRLNVEVDAAPTVDLNQVL

SEQ ID NO: 2681 - protein, 28 aa, Artificial
  Consensus peptide
VNTLRSPLGDRLNVEVDAAPTVDLNQVL

SEQ ID NO: 2682 - protein, 28 aa, Artificial
  Consensus peptide
VNTLRCQLGDRLNVEVDTAPTVDLNQVL

SEQ ID NO: 2683 - protein, 28 aa, Artificial
  Consensus peptide
VNTLRSQLGDRLNVEVDTAPTVDLNQVL

SEQ ID NO: 2684 - protein, 28 aa, Artificial
  Consensus peptide
VNTLRCPLGDRLNVEVDTAPTVDLNQVL

SEQ ID NO: 2685 - protein, 28 aa, Artificial
  Consensus peptide
VNTLRSPLGDRLNVEVDTAPTVDLNQVL

SEQ ID NO: 2686 - protein, 28 aa, Artificial
  Consensus peptide
VNTLRCQLGDRLNVEVDAAPTVDLNRVL

SEQ ID NO: 2687 - protein, 28 aa, Artificial
  Consensus peptide
VNTLRSQLGDRLNVEVDAAPTVDLNRVL

SEQ ID NO: 2688 - protein, 28 aa, Artificial
  Consensus peptide
VNTLRCPLGDRLNVEVDAAPTVDLNRVL

SEQ ID NO: 2689 - protein, 28 aa, Artificial
  Consensus peptide
VNTLRSPLGDRLNVEVDAAPTVDLNRVL

SEQ ID NO: 2690 - protein, 28 aa, Artificial
  Consensus peptide
VNTLRCQLGDRLNVEVDTAPTVDLNRVL

SEQ ID NO: 2691 - protein, 28 aa, Artificial
  Consensus peptide
VNTLRSQLGDRLNVEVDTAPTVDLNRVL

SEQ ID NO: 2692 - protein, 28 aa, Artificial
  Consensus peptide
VNTLRCPLGDRLNVEVDTAPTVDLNRVL

SEQ ID NO: 2693 - protein, 28 aa, Artificial
  Consensus peptide
VNTLRSPLGDRLNVEVDTAPTVDLNRVL

SEQ ID NO: 2694 - protein, 28 aa, Artificial
  Consensus peptide
NTLRCQLGDRLNVEVDAAPTVDLNQVLN

SEQ ID NO: 2695 - protein, 28 aa, Artificial
  Consensus peptide
NTLRSQLGDRLNVEVDAAPTVDLNQVLN

SEQ ID NO: 2696 - protein, 28 aa, Artificial
  Consensus peptide
NTLRCPLGDRLNVEVDAAPTVDLNQVLN

SEQ ID NO: 2697 - protein, 28 aa, Artificial
  Consensus peptide
NTLRSPLGDRLNVEVDAAPTVDLNQVLN

SEQ ID NO: 2698 - protein, 28 aa, Artificial
  Consensus peptide
NTLRCQLGDRLNVEVDTAPTVDLNQVLN

SEQ ID NO: 2699 - protein, 28 aa, Artificial
  Consensus peptide
NTLRSQLGDRLNVEVDTAPTVDLNQVLN

SEQ ID NO: 2700 - protein, 28 aa, Artificial
  Consensus peptide
NTLRCPLGDRLNVEVDTAPTVDLNQVLN

SEQ ID NO: 2701 - protein, 28 aa, Artificial
  Consensus peptide
NTLRSPLGDRLNVEVDTAPTVDLNQVLN

SEQ ID NO: 2702 - protein, 28 aa, Artificial
  Consensus peptide
NTLRCQLGDRLNVEVDAAPTVDLNRVLN

SEQ ID NO: 2703 - protein, 28 aa, Artificial
  Consensus peptide
NTLRSQLGDRLNVEVDAAPTVDLNRVLN

SEQ ID NO: 2704 - protein, 28 aa, Artificial
  Consensus peptide
NTLRCPLGDRLNVEVDAAPTVDLNRVLN

SEQ ID NO: 2705 - protein, 28 aa, Artificial
  Consensus peptide
NTLRSPLGDRLNVEVDAAPTVDLNRVLN

SEQ ID NO: 2706 - protein, 28 aa, Artificial
  Consensus peptide
NTLRCQLGDRLNVEVDTAPTVDLNRVLN

SEQ ID NO: 2707 - protein, 28 aa, Artificial
  Consensus peptide
NTLRSQLGDRLNVEVDTAPTVDLNRVLN

SEQ ID NO: 2708 - protein, 28 aa, Artificial
  Consensus peptide
NTLRCPLGDRLNVEVDTAPTVDLNRVLN

SEQ ID NO: 2709 - protein, 28 aa, Artificial
  Consensus peptide
NTLRSPLGDRLNVEVDTAPTVDLNRVLN

SEQ ID NO: 2710 - protein, 28 aa, Artificial
  Consensus peptide
TLRCQLGDRLNVEVDAAPTVDLNQVLNE

SEQ ID NO: 2711 - protein, 28 aa, Artificial
  Consensus peptide
TLRSQLGDRLNVEVDAAPTVDLNQVLNE

SEQ ID NO: 2712 - protein, 28 aa, Artificial
  Consensus peptide
TLRCPLGDRLNVEVDAAPTVDLNQVLNE

SEQ ID NO: 2713 - protein, 28 aa, Artificial
  Consensus peptide
TLRSPLGDRLNVEVDAAPTVDLNQVLNE

SEQ ID NO: 2714 - protein, 28 aa, Artificial
  Consensus peptide
TLRCQLGDRLNVEVDTAPTVDLNQVLNE

SEQ ID NO: 2715 - protein, 28 aa, Artificial
  Consensus peptide
TLRSQLGDRLNVEVDTAPTVDLNQVLNE

SEQ ID NO: 2716 - protein, 28 aa, Artificial
  Consensus peptide
TLRCPLGDRLNVEVDTAPTVDLNQVLNE

SEQ ID NO: 2717 - protein, 28 aa, Artificial
  Consensus peptide
TLRSPLGDRLNVEVDTAPTVDLNQVLNE

SEQ ID NO: 2718 - protein, 28 aa, Artificial
  Consensus peptide
TLRCQLGDRLNVEVDAAPTVDLNRVLNE

SEQ ID NO: 2719 - protein, 28 aa, Artificial
  Consensus peptide
TLRSQLGDRLNVEVDAAPTVDLNRVLNE

SEQ ID NO: 2720 - protein, 28 aa, Artificial
  Consensus peptide
TLRCPLGDRLNVEVDAAPTVDLNRVLNE

SEQ ID NO: 2721 - protein, 28 aa, Artificial
  Consensus peptide
TLRSPLGDRLNVEVDAAPTVDLNRVLNE

SEQ ID NO: 2722 - protein, 28 aa, Artificial
  Consensus peptide
TLRCQLGDRLNVEVDTAPTVDLNRVLNE

SEQ ID NO: 2723 - protein, 28 aa, Artificial
  Consensus peptide
TLRSQLGDRLNVEVDTAPTVDLNRVLNE

SEQ ID NO: 2724 - protein, 28 aa, Artificial
  Consensus peptide
TLRCPLGDRLNVEVDTAPTVDLNRVLNE

SEQ ID NO: 2725 - protein, 28 aa, Artificial
  Consensus peptide
TLRSPLGDRLNVEVDTAPTVDLNRVLNE

SEQ ID NO: 2726 - protein, 28 aa, Artificial
  Consensus peptide
LRCQLGDRLNVEVDAAPTVDLNQVLNET

SEQ ID NO: 2727 - protein, 28 aa, Artificial
  Consensus peptide
LRSQLGDRLNVEVDAAPTVDLNQVLNET

SEQ ID NO: 2728 - protein, 28 aa, Artificial
  Consensus peptide
LRCPLGDRLNVEVDAAPTVDLNQVLNET

SEQ ID NO: 2729 - protein, 28 aa, Artificial
  Consensus peptide
LRSPLGDRLNVEVDAAPTVDLNQVLNET

SEQ ID NO: 2730 - protein, 28 aa, Artificial
  Consensus peptide
LRCQLGDRLNVEVDTAPTVDLNQVLNET

SEQ ID NO: 2731 - protein, 28 aa, Artificial
  Consensus peptide
LRSQLGDRLNVEVDTAPTVDLNQVLNET

SEQ ID NO: 2732 - protein, 28 aa, Artificial
  Consensus peptide
LRCPLGDRLNVEVDTAPTVDLNQVLNET

SEQ ID NO: 2733 - protein, 28 aa, Artificial
  Consensus peptide
LRSPLGDRLNVEVDTAPTVDLNQVLNET

SEQ ID NO: 2734 - protein, 28 aa, Artificial
  Consensus peptide
LRCQLGDRLNVEVDAAPTVDLNRVLNET

SEQ ID NO: 2735 - protein, 28 aa, Artificial
  Consensus peptide
LRSQLGDRLNVEVDAAPTVDLNRVLNET

SEQ ID NO: 2736 - protein, 28 aa, Artificial
  Consensus peptide
LRCPLGDRLNVEVDAAPTVDLNRVLNET

SEQ ID NO: 2737 - protein, 28 aa, Artificial
  Consensus peptide
LRSPLGDRLNVEVDAAPTVDLNRVLNET

SEQ ID NO: 2738 - protein, 28 aa, Artificial
  Consensus peptide
LRCQLGDRLNVEVDTAPTVDLNRVLNET

SEQ ID NO: 2739 - protein, 28 aa, Artificial
  Consensus peptide
LRSQLGDRLNVEVDTAPTVDLNRVLNET

SEQ ID NO: 2740 - protein, 28 aa, Artificial
  Consensus peptide
LRCPLGDRLNVEVDTAPTVDLNRVLNET

SEQ ID NO: 2741 - protein, 28 aa, Artificial
  Consensus peptide
LRSPLGDRLNVEVDTAPTVDLNRVLNET

SEQ ID NO: 2742 - protein, 28 aa, Artificial
  Consensus peptide
RCQLGDRLNVEVDAAPTVDLNQVLNETR

SEQ ID NO: 2743 - protein, 28 aa, Artificial
  Consensus peptide
RSQLGDRLNVEVDAAPTVDLNQVLNETR

SEQ ID NO: 2744 - protein, 28 aa, Artificial
  Consensus peptide
RCPLGDRLNVEVDAAPTVDLNQVLNETR

SEQ ID NO: 2745 - protein, 28 aa, Artificial
  Consensus peptide
RSPLGDRLNVEVDAAPTVDLNQVLNETR

SEQ ID NO: 2746 - protein, 28 aa, Artificial
  Consensus peptide
RCQLGDRLNVEVDTAPTVDLNQVLNETR

SEQ ID NO: 2747 - protein, 28 aa, Artificial
  Consensus peptide
RSQLGDRLNVEVDTAPTVDLNQVLNETR

SEQ ID NO: 2748 - protein, 28 aa, Artificial
  Consensus peptide
RCPLGDRLNVEVDTAPTVDLNQVLNETR

SEQ ID NO: 2749 - protein, 28 aa, Artificial
  Consensus peptide
RSPLGDRLNVEVDTAPTVDLNQVLNETR

SEQ ID NO: 2750 - protein, 28 aa, Artificial
  Consensus peptide
RCQLGDRLNVEVDAAPTVDLNRVLNETR

SEQ ID NO: 2751 - protein, 28 aa, Artificial
  Consensus peptide
RSQLGDRLNVEVDAAPTVDLNRVLNETR

SEQ ID NO: 2752 - protein, 28 aa, Artificial
  Consensus peptide
RCPLGDRLNVEVDAAPTVDLNRVLNETR

SEQ ID NO: 2753 - protein, 28 aa, Artificial
  Consensus peptide
RSPLGDRLNVEVDAAPTVDLNRVLNETR

SEQ ID NO: 2754 - protein, 28 aa, Artificial
  Consensus peptide
RCQLGDRLNVEVDTAPTVDLNRVLNETR

SEQ ID NO: 2755 - protein, 28 aa, Artificial
  Consensus peptide
RSQLGDRLNVEVDTAPTVDLNRVLNETR

SEQ ID NO: 2756 - protein, 28 aa, Artificial
  Consensus peptide
RCPLGDRLNVEVDTAPTVDLNRVLNETR

SEQ ID NO: 2757 - protein, 28 aa, Artificial
  Consensus peptide
RSPLGDRLNVEVDTAPTVDLNRVLNETR

SEQ ID NO: 2758 - protein, 28 aa, Artificial
  Consensus peptide
CQLGDRLNVEVDAAPTVDLNQVLNETRS

SEQ ID NO: 2759 - protein, 28 aa, Artificial
  Consensus peptide
SQLGDRLNVEVDAAPTVDLNQVLNETRS

SEQ ID NO: 2760 - protein, 28 aa, Artificial
  Consensus peptide
CPLGDRLNVEVDAAPTVDLNQVLNETRS

SEQ ID NO: 2761 - protein, 28 aa, Artificial
  Consensus peptide
SPLGDRLNVEVDAAPTVDLNQVLNETRS

SEQ ID NO: 2762 - protein, 28 aa, Artificial
  Consensus peptide
CQLGDRLNVEVDTAPTVDLNQVLNETRS

SEQ ID NO: 2763 - protein, 28 aa, Artificial
  Consensus peptide
SQLGDRLNVEVDTAPTVDLNQVLNETRS

SEQ ID NO: 2764 - protein, 28 aa, Artificial
  Consensus peptide
CPLGDRLNVEVDTAPTVDLNQVLNETRS

SEQ ID NO: 2765 - protein, 28 aa, Artificial
  Consensus peptide
SPLGDRLNVEVDTAPTVDLNQVLNETRS

SEQ ID NO: 2766 - protein, 28 aa, Artificial
  Consensus peptide
CQLGDRLNVEVDAAPTVDLNRVLNETRS

SEQ ID NO: 2767 - protein, 28 aa, Artificial
  Consensus peptide
SQLGDRLNVEVDAAPTVDLNRVLNETRS

SEQ ID NO: 2768 - protein, 28 aa, Artificial
  Consensus peptide
CPLGDRLNVEVDAAPTVDLNRVLNETRS

SEQ ID NO: 2769 - protein, 28 aa, Artificial
  Consensus peptide
SPLGDRLNVEVDAAPTVDLNRVLNETRS

SEQ ID NO: 2770 - protein, 28 aa, Artificial
  Consensus peptide
CQLGDRLNVEVDTAPTVDLNRVLNETRS

SEQ ID NO: 2771 - protein, 28 aa, Artificial
  Consensus peptide
SQLGDRLNVEVDTAPTVDLNRVLNETRS

SEQ ID NO: 2772 - protein, 28 aa, Artificial
  Consensus peptide
CPLGDRLNVEVDTAPTVDLNRVLNETRS

SEQ ID NO: 2773 - protein, 28 aa, Artificial
  Consensus peptide
SPLGDRLNVEVDTAPTVDLNRVLNETRS

SEQ ID NO: 2774 - protein, 28 aa, Artificial
  Consensus peptide
CQLGDRLNVEVDAAPTVDLNQVLNETRN

SEQ ID NO: 2775 - protein, 28 aa, Artificial
  Consensus peptide
SQLGDRLNVEVDAAPTVDLNQVLNETRN

SEQ ID NO: 2776 - protein, 28 aa, Artificial
  Consensus peptide
CPLGDRLNVEVDAAPTVDLNQVLNETRN

SEQ ID NO: 2777 - protein, 28 aa, Artificial
  Consensus peptide
SPLGDRLNVEVDAAPTVDLNQVLNETRN

SEQ ID NO: 2778 - protein, 28 aa, Artificial
  Consensus peptide
CQLGDRLNVEVDTAPTVDLNQVLNETRN

SEQ ID NO: 2779 - protein, 28 aa, Artificial
  Consensus peptide
SQLGDRLNVEVDTAPTVDLNQVLNETRN

SEQ ID NO: 2780 - protein, 28 aa, Artificial
  Consensus peptide
CPLGDRLNVEVDTAPTVDLNQVLNETRN

SEQ ID NO: 2781 - protein, 28 aa, Artificial
  Consensus peptide
SPLGDRLNVEVDTAPTVDLNQVLNETRN

SEQ ID NO: 2782 - protein, 28 aa, Artificial
  Consensus peptide
CQLGDRLNVEVDAAPTVDLNRVLNETRN

SEQ ID NO: 2783 - protein, 28 aa, Artificial
  Consensus peptide
SQLGDRLNVEVDAAPTVDLNRVLNETRN

SEQ ID NO: 2784 - protein, 28 aa, Artificial
  Consensus peptide
CPLGDRLNVEVDAAPTVDLNRVLNETRN

SEQ ID NO: 2785 - protein, 28 aa, Artificial
  Consensus peptide
SPLGDRLNVEVDAAPTVDLNRVLNETRN

SEQ ID NO: 2786 - protein, 28 aa, Artificial
  Consensus peptide
CQLGDRLNVEVDTAPTVDLNRVLNETRN

SEQ ID NO: 2787 - protein, 28 aa, Artificial
  Consensus peptide
SQLGDRLNVEVDTAPTVDLNRVLNETRN

SEQ ID NO: 2788 - protein, 28 aa, Artificial
  Consensus peptide
CPLGDRLNVEVDTAPTVDLNRVLNETRN

SEQ ID NO: 2789 - protein, 28 aa, Artificial
  Consensus peptide
SPLGDRLNVEVDTAPTVDLNRVLNETRN

SEQ ID NO: 2790 - protein, 28 aa, Artificial
  Consensus peptide
QLGDRLNVEVDAAPTVDLNQVLNETRSQ

SEQ ID NO: 2791 - protein, 28 aa, Artificial
  Consensus peptide
PLGDRLNVEVDAAPTVDLNQVLNETRSQ

SEQ ID NO: 2792 - protein, 28 aa, Artificial
  Consensus peptide
QLGDRLNVEVDTAPTVDLNQVLNETRSQ

SEQ ID NO: 2793 - protein, 28 aa, Artificial
  Consensus peptide
PLGDRLNVEVDTAPTVDLNQVLNETRSQ

SEQ ID NO: 2794 - protein, 28 aa, Artificial
  Consensus peptide
QLGDRLNVEVDAAPTVDLNRVLNETRSQ

SEQ ID NO: 2795 - protein, 28 aa, Artificial
  Consensus peptide
PLGDRLNVEVDAAPTVDLNRVLNETRSQ

SEQ ID NO: 2796 - protein, 28 aa, Artificial
  Consensus peptide
QLGDRLNVEVDTAPTVDLNRVLNETRSQ

SEQ ID NO: 2797 - protein, 28 aa, Artificial
  Consensus peptide
PLGDRLNVEVDTAPTVDLNRVLNETRSQ

SEQ ID NO: 2798 - protein, 28 aa, Artificial
  Consensus peptide
QLGDRLNVEVDAAPTVDLNQVLNETRNQ

SEQ ID NO: 2799 - protein, 28 aa, Artificial
  Consensus peptide
PLGDRLNVEVDAAPTVDLNQVLNETRNQ

SEQ ID NO: 2800 - protein, 28 aa, Artificial
  Consensus peptide
QLGDRLNVEVDTAPTVDLNQVLNETRNQ

SEQ ID NO: 2801 - protein, 28 aa, Artificial
  Consensus peptide
PLGDRLNVEVDTAPTVDLNQVLNETRNQ

SEQ ID NO: 2802 - protein, 28 aa, Artificial
  Consensus peptide
QLGDRLNVEVDAAPTVDLNRVLNETRNQ

SEQ ID NO: 2803 - protein, 28 aa, Artificial
  Consensus peptide
PLGDRLNVEVDAAPTVDLNRVLNETRNQ

SEQ ID NO: 2804 - protein, 28 aa, Artificial
  Consensus peptide
QLGDRLNVEVDTAPTVDLNRVLNETRNQ

SEQ ID NO: 2805 - protein, 28 aa, Artificial
  Consensus peptide
PLGDRLNVEVDTAPTVDLNRVLNETRNQ

SEQ ID NO: 2806 - protein, 28 aa, Artificial
  Consensus peptide
LGDRLNVEVDAAPTVDLNQVLNETRSQY

SEQ ID NO: 2807 - protein, 28 aa, Artificial
  Consensus peptide
LGDRLNVEVDTAPTVDLNQVLNETRSQY

SEQ ID NO: 2808 - protein, 28 aa, Artificial
  Consensus peptide
LGDRLNVEVDAAPTVDLNRVLNETRSQY

SEQ ID NO: 2809 - protein, 28 aa, Artificial
  Consensus peptide
LGDRLNVEVDTAPTVDLNRVLNETRSQY

SEQ ID NO: 2810 - protein, 28 aa, Artificial
  Consensus peptide
LGDRLNVEVDAAPTVDLNQVLNETRNQY

SEQ ID NO: 2811 - protein, 28 aa, Artificial
  Consensus peptide
LGDRLNVEVDTAPTVDLNQVLNETRNQY

SEQ ID NO: 2812 - protein, 28 aa, Artificial
  Consensus peptide
LGDRLNVEVDAAPTVDLNRVLNETRNQY

SEQ ID NO: 2813 - protein, 28 aa, Artificial
  Consensus peptide
LGDRLNVEVDTAPTVDLNRVLNETRNQY

SEQ ID NO: 2814 - protein, 28 aa, Artificial
  Consensus peptide
GDRLNVEVDAAPTVDLNQVLNETRSQYE

SEQ ID NO: 2815 - protein, 28 aa, Artificial
  Consensus peptide
GDRLNVEVDTAPTVDLNQVLNETRSQYE

SEQ ID NO: 2816 - protein, 28 aa, Artificial
  Consensus peptide
GDRLNVEVDAAPTVDLNRVLNETRSQYE

SEQ ID NO: 2817 - protein, 28 aa, Artificial
  Consensus peptide
GDRLNVEVDTAPTVDLNRVLNETRSQYE

SEQ ID NO: 2818 - protein, 28 aa, Artificial
  Consensus peptide
GDRLNVEVDAAPTVDLNQVLNETRNQYE

SEQ ID NO: 2819 - protein, 28 aa, Artificial
  Consensus peptide
GDRLNVEVDTAPTVDLNQVLNETRNQYE

SEQ ID NO: 2820 - protein, 28 aa, Artificial
  Consensus peptide
GDRLNVEVDAAPTVDLNRVLNETRNQYE

SEQ ID NO: 2821 - protein, 28 aa, Artificial
  Consensus peptide
GDRLNVEVDTAPTVDLNRVLNETRNQYE

SEQ ID NO: 2822 - protein, 28 aa, Artificial
  Consensus peptide
DRLNVEVDAAPTVDLNQVLNETRSQYEA

SEQ ID NO: 2823 - protein, 28 aa, Artificial
  Consensus peptide
DRLNVEVDTAPTVDLNQVLNETRSQYEA

SEQ ID NO: 2824 - protein, 28 aa, Artificial
  Consensus peptide
DRLNVEVDAAPTVDLNRVLNETRSQYEA

SEQ ID NO: 2825 - protein, 28 aa, Artificial
  Consensus peptide
DRLNVEVDTAPTVDLNRVLNETRSQYEA

SEQ ID NO: 2826 - protein, 28 aa, Artificial
  Consensus peptide
DRLNVEVDAAPTVDLNQVLNETRNQYEA

SEQ ID NO: 2827 - protein, 28 aa, Artificial
  Consensus peptide
DRLNVEVDTAPTVDLNQVLNETRNQYEA

SEQ ID NO: 2828 - protein, 28 aa, Artificial
  Consensus peptide
DRLNVEVDAAPTVDLNRVLNETRNQYEA

SEQ ID NO: 2829 - protein, 28 aa, Artificial
  Consensus peptide
DRLNVEVDTAPTVDLNRVLNETRNQYEA

SEQ ID NO: 2830 - protein, 28 aa, Artificial
  Consensus peptide
RLNVEVDAAPTVDLNQVLNETRSQYEAL

SEQ ID NO: 2831 - protein, 28 aa, Artificial
  Consensus peptide
RLNVEVDTAPTVDLNQVLNETRSQYEAL

SEQ ID NO: 2832 - protein, 28 aa, Artificial
  Consensus peptide
RLNVEVDAAPTVDLNRVLNETRSQYEAL

SEQ ID NO: 2833 - protein, 28 aa, Artificial
  Consensus peptide
RLNVEVDTAPTVDLNRVLNETRSQYEAL

SEQ ID NO: 2834 - protein, 28 aa, Artificial
  Consensus peptide
RLNVEVDAAPTVDLNQVLNETRNQYEAL

SEQ ID NO: 2835 - protein, 28 aa, Artificial
  Consensus peptide
RLNVEVDTAPTVDLNQVLNETRNQYEAL

SEQ ID NO: 2836 - protein, 28 aa, Artificial
  Consensus peptide
RLNVEVDAAPTVDLNRVLNETRNQYEAL

SEQ ID NO: 2837 - protein, 28 aa, Artificial
  Consensus peptide
RLNVEVDTAPTVDLNRVLNETRNQYEAL

SEQ ID NO: 2838 - protein, 29 aa, Artificial
  Consensus peptide
EVNTLRCQLGDRLNVEVDAAPTVDLNQVL

SEQ ID NO: 2839 - protein, 29 aa, Artificial
  Consensus peptide
EVNTLRSQLGDRLNVEVDAAPTVDLNQVL

SEQ ID NO: 2840 - protein, 29 aa, Artificial
  Consensus peptide
EVNTLRCPLGDRLNVEVDAAPTVDLNQVL

SEQ ID NO: 2841 - protein, 29 aa, Artificial
  Consensus peptide
EVNTLRSPLGDRLNVEVDAAPTVDLNQVL

SEQ ID NO: 2842 - protein, 29 aa, Artificial
  Consensus peptide
EVNTLRCQLGDRLNVEVDTAPTVDLNQVL

SEQ ID NO: 2843 - protein, 29 aa, Artificial
  Consensus peptide
EVNTLRSQLGDRLNVEVDTAPTVDLNQVL

SEQ ID NO: 2844 - protein, 29 aa, Artificial
  Consensus peptide
EVNTLRCPLGDRLNVEVDTAPTVDLNQVL

SEQ ID NO: 2845 - protein, 29 aa, Artificial
  Consensus peptide
EVNTLRSPLGDRLNVEVDTAPTVDLNQVL

SEQ ID NO: 2846 - protein, 29 aa, Artificial
  Consensus peptide
EVNTLRCQLGDRLNVEVDAAPTVDLNRVL

SEQ ID NO: 2847 - protein, 29 aa, Artificial
  Consensus peptide
EVNTLRSQLGDRLNVEVDAAPTVDLNRVL

SEQ ID NO: 2848 - protein, 29 aa, Artificial
  Consensus peptide
EVNTLRCPLGDRLNVEVDAAPTVDLNRVL

SEQ ID NO: 2849 - protein, 29 aa, Artificial
  Consensus peptide
EVNTLRSPLGDRLNVEVDAAPTVDLNRVL

SEQ ID NO: 2850 - protein, 29 aa, Artificial
  Consensus peptide
EVNTLRCQLGDRLNVEVDTAPTVDLNRVL

SEQ ID NO: 2851 - protein, 29 aa, Artificial
  Consensus peptide
EVNTLRSQLGDRLNVEVDTAPTVDLNRVL

SEQ ID NO: 2852 - protein, 29 aa, Artificial
  Consensus peptide
EVNTLRCPLGDRLNVEVDTAPTVDLNRVL

SEQ ID NO: 2853 - protein, 29 aa, Artificial
  Consensus peptide
EVNTLRSPLGDRLNVEVDTAPTVDLNRVL

SEQ ID NO: 2854 - protein, 29 aa, Artificial
  Consensus peptide
VNTLRCQLGDRLNVEVDAAPTVDLNQVLN

SEQ ID NO: 2855 - protein, 29 aa, Artificial
  Consensus peptide
VNTLRSQLGDRLNVEVDAAPTVDLNQVLN

SEQ ID NO: 2856 - protein, 29 aa, Artificial
  Consensus peptide
VNTLRCPLGDRLNVEVDAAPTVDLNQVLN

SEQ ID NO: 2857 - protein, 29 aa, Artificial
  Consensus peptide
VNTLRSPLGDRLNVEVDAAPTVDLNQVLN

SEQ ID NO: 2858 - protein, 29 aa, Artificial
  Consensus peptide
VNTLRCQLGDRLNVEVDTAPTVDLNQVLN

SEQ ID NO: 2859 - protein, 29 aa, Artificial
  Consensus peptide
VNTLRSQLGDRLNVEVDTAPTVDLNQVLN

SEQ ID NO: 2860 - protein, 29 aa, Artificial
  Consensus peptide
VNTLRCPLGDRLNVEVDTAPTVDLNQVLN

SEQ ID NO: 2861 - protein, 29 aa, Artificial
  Consensus peptide
VNTLRSPLGDRLNVEVDTAPTVDLNQVLN

SEQ ID NO: 2862 - protein, 29 aa, Artificial
  Consensus peptide
VNTLRCQLGDRLNVEVDAAPTVDLNRVLN

SEQ ID NO: 2863 - protein, 29 aa, Artificial
  Consensus peptide
VNTLRSQLGDRLNVEVDAAPTVDLNRVLN

SEQ ID NO: 2864 - protein, 29 aa, Artificial
  Consensus peptide
VNTLRCPLGDRLNVEVDAAPTVDLNRVLN

SEQ ID NO: 2865 - protein, 29 aa, Artificial
  Consensus peptide
VNTLRSPLGDRLNVEVDAAPTVDLNRVLN

SEQ ID NO: 2866 - protein, 29 aa, Artificial
  Consensus peptide
VNTLRCQLGDRLNVEVDTAPTVDLNRVLN

SEQ ID NO: 2867 - protein, 29 aa, Artificial
  Consensus peptide
VNTLRSQLGDRLNVEVDTAPTVDLNRVLN

SEQ ID NO: 2868 - protein, 29 aa, Artificial
  Consensus peptide
VNTLRCPLGDRLNVEVDTAPTVDLNRVLN

SEQ ID NO: 2869 - protein, 29 aa, Artificial
  Consensus peptide
VNTLRSPLGDRLNVEVDTAPTVDLNRVLN

SEQ ID NO: 2870 - protein, 29 aa, Artificial
  Consensus peptide
NTLRCQLGDRLNVEVDAAPTVDLNQVLNE

SEQ ID NO: 2871 - protein, 29 aa, Artificial
  Consensus peptide
NTLRSQLGDRLNVEVDAAPTVDLNQVLNE

SEQ ID NO: 2872 - protein, 29 aa, Artificial
  Consensus peptide
NTLRCPLGDRLNVEVDAAPTVDLNQVLNE

SEQ ID NO: 2873 - protein, 29 aa, Artificial
  Consensus peptide
NTLRSPLGDRLNVEVDAAPTVDLNQVLNE

SEQ ID NO: 2874 - protein, 29 aa, Artificial
  Consensus peptide
NTLRCQLGDRLNVEVDTAPTVDLNQVLNE

SEQ ID NO: 2875 - protein, 29 aa, Artificial
  Consensus peptide
NTLRSQLGDRLNVEVDTAPTVDLNQVLNE

SEQ ID NO: 2876 - protein, 29 aa, Artificial
  Consensus peptide
NTLRCPLGDRLNVEVDTAPTVDLNQVLNE

SEQ ID NO: 2877 - protein, 29 aa, Artificial
  Consensus peptide
NTLRSPLGDRLNVEVDTAPTVDLNQVLNE

SEQ ID NO: 2878 - protein, 29 aa, Artificial
  Consensus peptide
NTLRCQLGDRLNVEVDAAPTVDLNRVLNE

SEQ ID NO: 2879 - protein, 29 aa, Artificial
  Consensus peptide
NTLRSQLGDRLNVEVDAAPTVDLNRVLNE

SEQ ID NO: 2880 - protein, 29 aa, Artificial
  Consensus peptide
NTLRCPLGDRLNVEVDAAPTVDLNRVLNE

SEQ ID NO: 2881 - protein, 29 aa, Artificial
  Consensus peptide
NTLRSPLGDRLNVEVDAAPTVDLNRVLNE

SEQ ID NO: 2882 - protein, 29 aa, Artificial
  Consensus peptide
NTLRCQLGDRLNVEVDTAPTVDLNRVLNE

SEQ ID NO: 2883 - protein, 29 aa, Artificial
  Consensus peptide
NTLRSQLGDRLNVEVDTAPTVDLNRVLNE

SEQ ID NO: 2884 - protein, 29 aa, Artificial
  Consensus peptide
NTLRCPLGDRLNVEVDTAPTVDLNRVLNE

SEQ ID NO: 2885 - protein, 29 aa, Artificial
  Consensus peptide
NTLRSPLGDRLNVEVDTAPTVDLNRVLNE

SEQ ID NO: 2886 - protein, 29 aa, Artificial
  Consensus peptide
TLRCQLGDRLNVEVDAAPTVDLNQVLNET

SEQ ID NO: 2887 - protein, 29 aa, Artificial
  Consensus peptide
TLRSQLGDRLNVEVDAAPTVDLNQVLNET

SEQ ID NO: 2888 - protein, 29 aa, Artificial
  Consensus peptide
TLRCPLGDRLNVEVDAAPTVDLNQVLNET

SEQ ID NO: 2889 - protein, 29 aa, Artificial
  Consensus peptide
TLRSPLGDRLNVEVDAAPTVDLNQVLNET

SEQ ID NO: 2890 - protein, 29 aa, Artificial
  Consensus peptide
TLRCQLGDRLNVEVDTAPTVDLNQVLNET

SEQ ID NO: 2891 - protein, 29 aa, Artificial
  Consensus peptide
TLRSQLGDRLNVEVDTAPTVDLNQVLNET

SEQ ID NO: 2892 - protein, 29 aa, Artificial
  Consensus peptide
TLRCPLGDRLNVEVDTAPTVDLNQVLNET

SEQ ID NO: 2893 - protein, 29 aa, Artificial
  Consensus peptide
TLRSPLGDRLNVEVDTAPTVDLNQVLNET

SEQ ID NO: 2894 - protein, 29 aa, Artificial
  Consensus peptide
TLRCQLGDRLNVEVDAAPTVDLNRVLNET

SEQ ID NO: 2895 - protein, 29 aa, Artificial
  Consensus peptide
TLRSQLGDRLNVEVDAAPTVDLNRVLNET

SEQ ID NO: 2896 - protein, 29 aa, Artificial
  Consensus peptide
TLRCPLGDRLNVEVDAAPTVDLNRVLNET

SEQ ID NO: 2897 - protein, 29 aa, Artificial
  Consensus peptide
TLRSPLGDRLNVEVDAAPTVDLNRVLNET

SEQ ID NO: 2898 - protein, 29 aa, Artificial
  Consensus peptide
TLRCQLGDRLNVEVDTAPTVDLNRVLNET

SEQ ID NO: 2899 - protein, 29 aa, Artificial
  Consensus peptide
TLRSQLGDRLNVEVDTAPTVDLNRVLNET

SEQ ID NO: 2900 - protein, 29 aa, Artificial
  Consensus peptide
TLRCPLGDRLNVEVDTAPTVDLNRVLNET

SEQ ID NO: 2901 - protein, 29 aa, Artificial
  Consensus peptide
TLRSPLGDRLNVEVDTAPTVDLNRVLNET

SEQ ID NO: 2902 - protein, 29 aa, Artificial
  Consensus peptide
LRCQLGDRLNVEVDAAPTVDLNQVLNETR

SEQ ID NO: 2903 - protein, 29 aa, Artificial
  Consensus peptide
LRSQLGDRLNVEVDAAPTVDLNQVLNETR

SEQ ID NO: 2904 - protein, 29 aa, Artificial
  Consensus peptide
LRCPLGDRLNVEVDAAPTVDLNQVLNETR

SEQ ID NO: 2905 - protein, 29 aa, Artificial
  Consensus peptide
LRSPLGDRLNVEVDAAPTVDLNQVLNETR

SEQ ID NO: 2906 - protein, 29 aa, Artificial
  Consensus peptide
LRCQLGDRLNVEVDTAPTVDLNQVLNETR

SEQ ID NO: 2907 - protein, 29 aa, Artificial
  Consensus peptide
LRSQLGDRLNVEVDTAPTVDLNQVLNETR

SEQ ID NO: 2908 - protein, 29 aa, Artificial
  Consensus peptide
LRCPLGDRLNVEVDTAPTVDLNQVLNETR

SEQ ID NO: 2909 - protein, 29 aa, Artificial
  Consensus peptide
LRSPLGDRLNVEVDTAPTVDLNQVLNETR

SEQ ID NO: 2910 - protein, 29 aa, Artificial
  Consensus peptide
LRCQLGDRLNVEVDAAPTVDLNRVLNETR

SEQ ID NO: 2911 - protein, 29 aa, Artificial
  Consensus peptide
LRSQLGDRLNVEVDAAPTVDLNRVLNETR

SEQ ID NO: 2912 - protein, 29 aa, Artificial
  Consensus peptide
LRCPLGDRLNVEVDAAPTVDLNRVLNETR

SEQ ID NO: 2913 - protein, 29 aa, Artificial
  Consensus peptide
LRSPLGDRLNVEVDAAPTVDLNRVLNETR

SEQ ID NO: 2914 - protein, 29 aa, Artificial
  Consensus peptide
LRCQLGDRLNVEVDTAPTVDLNRVLNETR

SEQ ID NO: 2915 - protein, 29 aa, Artificial
  Consensus peptide
LRSQLGDRLNVEVDTAPTVDLNRVLNETR

SEQ ID NO: 2916 - protein, 29 aa, Artificial
  Consensus peptide
LRCPLGDRLNVEVDTAPTVDLNRVLNETR

SEQ ID NO: 2917 - protein, 29 aa, Artificial
  Consensus peptide
LRSPLGDRLNVEVDTAPTVDLNRVLNETR

SEQ ID NO: 2918 - protein, 29 aa, Artificial
  Consensus peptide
RCQLGDRLNVEVDAAPTVDLNQVLNETRS

SEQ ID NO: 2919 - protein, 29 aa, Artificial
  Consensus peptide
RSQLGDRLNVEVDAAPTVDLNQVLNETRS

SEQ ID NO: 2920 - protein, 29 aa, Artificial
  Consensus peptide
RCPLGDRLNVEVDAAPTVDLNQVLNETRS

SEQ ID NO: 2921 - protein, 29 aa, Artificial
  Consensus peptide
RSPLGDRLNVEVDAAPTVDLNQVLNETRS

SEQ ID NO: 2922 - protein, 29 aa, Artificial
  Consensus peptide
RCQLGDRLNVEVDTAPTVDLNQVLNETRS

SEQ ID NO: 2923 - protein, 29 aa, Artificial
  Consensus peptide
RSQLGDRLNVEVDTAPTVDLNQVLNETRS

SEQ ID NO: 2924 - protein, 29 aa, Artificial
  Consensus peptide
RCPLGDRLNVEVDTAPTVDLNQVLNETRS

SEQ ID NO: 2925 - protein, 29 aa, Artificial
  Consensus peptide
RSPLGDRLNVEVDTAPTVDLNQVLNETRS

SEQ ID NO: 2926 - protein, 29 aa, Artificial
  Consensus peptide
RCQLGDRLNVEVDAAPTVDLNRVLNETRS

SEQ ID NO: 2927 - protein, 29 aa, Artificial
  Consensus peptide
RSQLGDRLNVEVDAAPTVDLNRVLNETRS

SEQ ID NO: 2928 - protein, 29 aa, Artificial
  Consensus peptide
RCPLGDRLNVEVDAAPTVDLNRVLNETRS

SEQ ID NO: 2929 - protein, 29 aa, Artificial
  Consensus peptide
RSPLGDRLNVEVDAAPTVDLNRVLNETRS

SEQ ID NO: 2930 - protein, 29 aa, Artificial
  Consensus peptide
RCQLGDRLNVEVDTAPTVDLNRVLNETRS

SEQ ID NO: 2931 - protein, 29 aa, Artificial
  Consensus peptide
RSQLGDRLNVEVDTAPTVDLNRVLNETRS

SEQ ID NO: 2932 - protein, 29 aa, Artificial
  Consensus peptide
RCPLGDRLNVEVDTAPTVDLNRVLNETRS

SEQ ID NO: 2933 - protein, 29 aa, Artificial
  Consensus peptide
RSPLGDRLNVEVDTAPTVDLNRVLNETRS

SEQ ID NO: 2934 - protein, 29 aa, Artificial
  Consensus peptide
RCQLGDRLNVEVDAAPTVDLNQVLNETRN

SEQ ID NO: 2935 - protein, 29 aa, Artificial
  Consensus peptide
RSQLGDRLNVEVDAAPTVDLNQVLNETRN

SEQ ID NO: 2936 - protein, 29 aa, Artificial
  Consensus peptide
RCPLGDRLNVEVDAAPTVDLNQVLNETRN

SEQ ID NO: 2937 - protein, 29 aa, Artificial
  Consensus peptide
RSPLGDRLNVEVDAAPTVDLNQVLNETRN

SEQ ID NO: 2938 - protein, 29 aa, Artificial
  Consensus peptide
RCQLGDRLNVEVDTAPTVDLNQVLNETRN

SEQ ID NO: 2939 - protein, 29 aa, Artificial
  Consensus peptide
RSQLGDRLNVEVDTAPTVDLNQVLNETRN

SEQ ID NO: 2940 - protein, 29 aa, Artificial
  Consensus peptide
RCPLGDRLNVEVDTAPTVDLNQVLNETRN

SEQ ID NO: 2941 - protein, 29 aa, Artificial
  Consensus peptide
RSPLGDRLNVEVDTAPTVDLNQVLNETRN

SEQ ID NO: 2942 - protein, 29 aa, Artificial
  Consensus peptide
RCQLGDRLNVEVDAAPTVDLNRVLNETRN

SEQ ID NO: 2943 - protein, 29 aa, Artificial
  Consensus peptide
RSQLGDRLNVEVDAAPTVDLNRVLNETRN

SEQ ID NO: 2944 - protein, 29 aa, Artificial
  Consensus peptide
RCPLGDRLNVEVDAAPTVDLNRVLNETRN

SEQ ID NO: 2945 - protein, 29 aa, Artificial
  Consensus peptide
RSPLGDRLNVEVDAAPTVDLNRVLNETRN

SEQ ID NO: 2946 - protein, 29 aa, Artificial
  Consensus peptide
RCQLGDRLNVEVDTAPTVDLNRVLNETRN

SEQ ID NO: 2947 - protein, 29 aa, Artificial
  Consensus peptide
RSQLGDRLNVEVDTAPTVDLNRVLNETRN

SEQ ID NO: 2948 - protein, 29 aa, Artificial
  Consensus peptide
RCPLGDRLNVEVDTAPTVDLNRVLNETRN

SEQ ID NO: 2949 - protein, 29 aa, Artificial
  Consensus peptide
RSPLGDRLNVEVDTAPTVDLNRVLNETRN

SEQ ID NO: 2950 - protein, 29 aa, Artificial
  Consensus peptide
CQLGDRLNVEVDAAPTVDLNQVLNETRSQ

SEQ ID NO: 2951 - protein, 29 aa, Artificial
  Consensus peptide
SQLGDRLNVEVDAAPTVDLNQVLNETRSQ

SEQ ID NO: 2952 - protein, 29 aa, Artificial
  Consensus peptide
CPLGDRLNVEVDAAPTVDLNQVLNETRSQ

SEQ ID NO: 2953 - protein, 29 aa, Artificial
  Consensus peptide
SPLGDRLNVEVDAAPTVDLNQVLNETRSQ

SEQ ID NO: 2954 - protein, 29 aa, Artificial
  Consensus peptide
CQLGDRLNVEVDTAPTVDLNQVLNETRSQ

SEQ ID NO: 2955 - protein, 29 aa, Artificial
  Consensus peptide
SQLGDRLNVEVDTAPTVDLNQVLNETRSQ

SEQ ID NO: 2956 - protein, 29 aa, Artificial
  Consensus peptide
CPLGDRLNVEVDTAPTVDLNQVLNETRSQ

SEQ ID NO: 2957 - protein, 29 aa, Artificial
  Consensus peptide
SPLGDRLNVEVDTAPTVDLNQVLNETRSQ

SEQ ID NO: 2958 - protein, 29 aa, Artificial
  Consensus peptide
CQLGDRLNVEVDAAPTVDLNRVLNETRSQ

SEQ ID NO: 2959 - protein, 29 aa, Artificial
  Consensus peptide
SQLGDRLNVEVDAAPTVDLNRVLNETRSQ

SEQ ID NO: 2960 - protein, 29 aa, Artificial
  Consensus peptide
CPLGDRLNVEVDAAPTVDLNRVLNETRSQ

SEQ ID NO: 2961 - protein, 29 aa, Artificial
  Consensus peptide
SPLGDRLNVEVDAAPTVDLNRVLNETRSQ

SEQ ID NO: 2962 - protein, 29 aa, Artificial
  Consensus peptide
CQLGDRLNVEVDTAPTVDLNRVLNETRSQ

SEQ ID NO: 2963 - protein, 29 aa, Artificial
  Consensus peptide
SQLGDRLNVEVDTAPTVDLNRVLNETRSQ

SEQ ID NO: 2964 - protein, 29 aa, Artificial
  Consensus peptide
CPLGDRLNVEVDTAPTVDLNRVLNETRSQ

SEQ ID NO: 2965 - protein, 29 aa, Artificial
  Consensus peptide
SPLGDRLNVEVDTAPTVDLNRVLNETRSQ

SEQ ID NO: 2966 - protein, 29 aa, Artificial
  Consensus peptide
CQLGDRLNVEVDAAPTVDLNQVLNETRNQ

SEQ ID NO: 2967 - protein, 29 aa, Artificial
  Consensus peptide
SQLGDRLNVEVDAAPTVDLNQVLNETRNQ

SEQ ID NO: 2968 - protein, 29 aa, Artificial
  Consensus peptide
CPLGDRLNVEVDAAPTVDLNQVLNETRNQ

SEQ ID NO: 2969 - protein, 29 aa, Artificial
  Consensus peptide
SPLGDRLNVEVDAAPTVDLNQVLNETRNQ

SEQ ID NO: 2970 - protein, 29 aa, Artificial
  Consensus peptide
CQLGDRLNVEVDTAPTVDLNQVLNETRNQ

SEQ ID NO: 2971 - protein, 29 aa, Artificial
  Consensus peptide
SQLGDRLNVEVDTAPTVDLNQVLNETRNQ

SEQ ID NO: 2972 - protein, 29 aa, Artificial
  Consensus peptide
CPLGDRLNVEVDTAPTVDLNQVLNETRNQ

SEQ ID NO: 2973 - protein, 29 aa, Artificial
  Consensus peptide
SPLGDRLNVEVDTAPTVDLNQVLNETRNQ

SEQ ID NO: 2974 - protein, 29 aa, Artificial
  Consensus peptide
CQLGDRLNVEVDAAPTVDLNRVLNETRNQ

SEQ ID NO: 2975 - protein, 29 aa, Artificial
  Consensus peptide
SQLGDRLNVEVDAAPTVDLNRVLNETRNQ

SEQ ID NO: 2976 - protein, 29 aa, Artificial
  Consensus peptide
CPLGDRLNVEVDAAPTVDLNRVLNETRNQ

SEQ ID NO: 2977 - protein, 29 aa, Artificial
  Consensus peptide
SPLGDRLNVEVDAAPTVDLNRVLNETRNQ

SEQ ID NO: 2978 - protein, 29 aa, Artificial
  Consensus peptide
CQLGDRLNVEVDTAPTVDLNRVLNETRNQ

SEQ ID NO: 2979 - protein, 29 aa, Artificial
  Consensus peptide
SQLGDRLNVEVDTAPTVDLNRVLNETRNQ

SEQ ID NO: 2980 - protein, 29 aa, Artificial
  Consensus peptide
CPLGDRLNVEVDTAPTVDLNRVLNETRNQ

SEQ ID NO: 2981 - protein, 29 aa, Artificial
  Consensus peptide
SPLGDRLNVEVDTAPTVDLNRVLNETRNQ

SEQ ID NO: 2982 - protein, 29 aa, Artificial
  Consensus peptide
QLGDRLNVEVDAAPTVDLNQVLNETRSQY

SEQ ID NO: 2983 - protein, 29 aa, Artificial
  Consensus peptide
PLGDRLNVEVDAAPTVDLNQVLNETRSQY

SEQ ID NO: 2984 - protein, 29 aa, Artificial
  Consensus peptide
QLGDRLNVEVDTAPTVDLNQVLNETRSQY

SEQ ID NO: 2985 - protein, 29 aa, Artificial
  Consensus peptide
PLGDRLNVEVDTAPTVDLNQVLNETRSQY

SEQ ID NO: 2986 - protein, 29 aa, Artificial
  Consensus peptide
QLGDRLNVEVDAAPTVDLNRVLNETRSQY

SEQ ID NO: 2987 - protein, 29 aa, Artificial
  Consensus peptide
PLGDRLNVEVDAAPTVDLNRVLNETRSQY

SEQ ID NO: 2988 - protein, 29 aa, Artificial
  Consensus peptide
QLGDRLNVEVDTAPTVDLNRVLNETRSQY

SEQ ID NO: 2989 - protein, 29 aa, Artificial
  Consensus peptide
PLGDRLNVEVDTAPTVDLNRVLNETRSQY

SEQ ID NO: 2990 - protein, 29 aa, Artificial
  Consensus peptide
QLGDRLNVEVDAAPTVDLNQVLNETRNQY

SEQ ID NO: 2991 - protein, 29 aa, Artificial
  Consensus peptide
PLGDRLNVEVDAAPTVDLNQVLNETRNQY

SEQ ID NO: 2992 - protein, 29 aa, Artificial
  Consensus peptide
QLGDRLNVEVDTAPTVDLNQVLNETRNQY

SEQ ID NO: 2993 - protein, 29 aa, Artificial
  Consensus peptide
PLGDRLNVEVDTAPTVDLNQVLNETRNQY

SEQ ID NO: 2994 - protein, 29 aa, Artificial
  Consensus peptide
QLGDRLNVEVDAAPTVDLNRVLNETRNQY

SEQ ID NO: 2995 - protein, 29 aa, Artificial
  Consensus peptide
PLGDRLNVEVDAAPTVDLNRVLNETRNQY

SEQ ID NO: 2996 - protein, 29 aa, Artificial
  Consensus peptide
QLGDRLNVEVDTAPTVDLNRVLNETRNQY

SEQ ID NO: 2997 - protein, 29 aa, Artificial
  Consensus peptide
PLGDRLNVEVDTAPTVDLNRVLNETRNQY

SEQ ID NO: 2998 - protein, 29 aa, Artificial
  Consensus peptide
LGDRLNVEVDAAPTVDLNQVLNETRSQYE

SEQ ID NO: 2999 - protein, 29 aa, Artificial
  Consensus peptide
LGDRLNVEVDTAPTVDLNQVLNETRSQYE

SEQ ID NO: 3000 - protein, 29 aa, Artificial
  Consensus peptide
LGDRLNVEVDAAPTVDLNRVLNETRSQYE

SEQ ID NO: 3001 - protein, 29 aa, Artificial
  Consensus peptide
LGDRLNVEVDTAPTVDLNRVLNETRSQYE

SEQ ID NO: 3002 - protein, 29 aa, Artificial
  Consensus peptide
LGDRLNVEVDAAPTVDLNQVLNETRNQYE

SEQ ID NO: 3003 - protein, 29 aa, Artificial
  Consensus peptide
LGDRLNVEVDTAPTVDLNQVLNETRNQYE

SEQ ID NO: 3004 - protein, 29 aa, Artificial
  Consensus peptide
LGDRLNVEVDAAPTVDLNRVLNETRNQYE

SEQ ID NO: 3005 - protein, 29 aa, Artificial
  Consensus peptide
LGDRLNVEVDTAPTVDLNRVLNETRNQYE

SEQ ID NO: 3006 - protein, 29 aa, Artificial
  Consensus peptide
GDRLNVEVDAAPTVDLNQVLNETRSQYEA

SEQ ID NO: 3007 - protein, 29 aa, Artificial
  Consensus peptide
GDRLNVEVDTAPTVDLNQVLNETRSQYEA

SEQ ID NO: 3008 - protein, 29 aa, Artificial
  Consensus peptide
GDRLNVEVDAAPTVDLNRVLNETRSQYEA

SEQ ID NO: 3009 - protein, 29 aa, Artificial
  Consensus peptide
GDRLNVEVDTAPTVDLNRVLNETRSQYEA

SEQ ID NO: 3010 - protein, 29 aa, Artificial
  Consensus peptide
GDRLNVEVDAAPTVDLNQVLNETRNQYEA

SEQ ID NO: 3011 - protein, 29 aa, Artificial
  Consensus peptide
GDRLNVEVDTAPTVDLNQVLNETRNQYEA

SEQ ID NO: 3012 - protein, 29 aa, Artificial
  Consensus peptide
GDRLNVEVDAAPTVDLNRVLNETRNQYEA

SEQ ID NO: 3013 - protein, 29 aa, Artificial
  Consensus peptide
GDRLNVEVDTAPTVDLNRVLNETRNQYEA

SEQ ID NO: 3014 - protein, 29 aa, Artificial
  Consensus peptide
DRLNVEVDAAPTVDLNQVLNETRSQYEAL

SEQ ID NO: 3015 - protein, 29 aa, Artificial
  Consensus peptide
DRLNVEVDTAPTVDLNQVLNETRSQYEAL

SEQ ID NO: 3016 - protein, 29 aa, Artificial
  Consensus peptide
DRLNVEVDAAPTVDLNRVLNETRSQYEAL

SEQ ID NO: 3017 - protein, 29 aa, Artificial
  Consensus peptide
DRLNVEVDTAPTVDLNRVLNETRSQYEAL

SEQ ID NO: 3018 - protein, 29 aa, Artificial
  Consensus peptide
DRLNVEVDAAPTVDLNQVLNETRNQYEAL

SEQ ID NO: 3019 - protein, 29 aa, Artificial
  Consensus peptide
DRLNVEVDTAPTVDLNQVLNETRNQYEAL

SEQ ID NO: 3020 - protein, 29 aa, Artificial
  Consensus peptide
DRLNVEVDAAPTVDLNRVLNETRNQYEAL

SEQ ID NO: 3021 - protein, 29 aa, Artificial
  Consensus peptide
DRLNVEVDTAPTVDLNRVLNETRNQYEAL

SEQ ID NO: 3022 - protein, 30 aa, Artificial
  Consensus peptide
EVNTLRCQLGDRLNVEVDAAPTVDLNQVLN

SEQ ID NO: 3023 - protein, 30 aa, Artificial
  Consensus peptide
EVNTLRSQLGDRLNVEVDAAPTVDLNQVLN

SEQ ID NO: 3024 - protein, 30 aa, Artificial
  Consensus peptide
EVNTLRCPLGDRLNVEVDAAPTVDLNQVLN

SEQ ID NO: 3025 - protein, 30 aa, Artificial
  Consensus peptide
EVNTLRSPLGDRLNVEVDAAPTVDLNQVLN

SEQ ID NO: 3026 - protein, 30 aa, Artificial
  Consensus peptide
EVNTLRCQLGDRLNVEVDTAPTVDLNQVLN

SEQ ID NO: 3027 - protein, 30 aa, Artificial
  Consensus peptide
EVNTLRSQLGDRLNVEVDTAPTVDLNQVLN

SEQ ID NO: 3028 - protein, 30 aa, Artificial
  Consensus peptide
EVNTLRCPLGDRLNVEVDTAPTVDLNQVLN

SEQ ID NO: 3029 - protein, 30 aa, Artificial
  Consensus peptide
EVNTLRSPLGDRLNVEVDTAPTVDLNQVLN

SEQ ID NO: 3030 - protein, 30 aa, Artificial
  Consensus peptide
EVNTLRCQLGDRLNVEVDAAPTVDLNRVLN

SEQ ID NO: 3031 - protein, 30 aa, Artificial
  Consensus peptide
EVNTLRSQLGDRLNVEVDAAPTVDLNRVLN

SEQ ID NO: 3032 - protein, 30 aa, Artificial
  Consensus peptide
EVNTLRCPLGDRLNVEVDAAPTVDLNRVLN

SEQ ID NO: 3033 - protein, 30 aa, Artificial
  Consensus peptide
EVNTLRSPLGDRLNVEVDAAPTVDLNRVLN

SEQ ID NO: 3034 - protein, 30 aa, Artificial
  Consensus peptide
EVNTLRCQLGDRLNVEVDTAPTVDLNRVLN

SEQ ID NO: 3035 - protein, 30 aa, Artificial
  Consensus peptide
EVNTLRSQLGDRLNVEVDTAPTVDLNRVLN

SEQ ID NO: 3036 - protein, 30 aa, Artificial
  Consensus peptide
EVNTLRCPLGDRLNVEVDTAPTVDLNRVLN

SEQ ID NO: 3037 - protein, 30 aa, Artificial
  Consensus peptide
EVNTLRSPLGDRLNVEVDTAPTVDLNRVLN

SEQ ID NO: 3038 - protein, 30 aa, Artificial
  Consensus peptide
VNTLRCQLGDRLNVEVDAAPTVDLNQVLNE

SEQ ID NO: 3039 - protein, 30 aa, Artificial
  Consensus peptide
VNTLRSQLGDRLNVEVDAAPTVDLNQVLNE

SEQ ID NO: 3040 - protein, 30 aa, Artificial
  Consensus peptide
VNTLRCPLGDRLNVEVDAAPTVDLNQVLNE

SEQ ID NO: 3041 - protein, 30 aa, Artificial
  Consensus peptide
VNTLRSPLGDRLNVEVDAAPTVDLNQVLNE

SEQ ID NO: 3042 - protein, 30 aa, Artificial
  Consensus peptide
VNTLRCQLGDRLNVEVDTAPTVDLNQVLNE

SEQ ID NO: 3043 - protein, 30 aa, Artificial
  Consensus peptide
VNTLRSQLGDRLNVEVDTAPTVDLNQVLNE

SEQ ID NO: 3044 - protein, 30 aa, Artificial
  Consensus peptide
VNTLRCPLGDRLNVEVDTAPTVDLNQVLNE

SEQ ID NO: 3045 - protein, 30 aa, Artificial
  Consensus peptide
VNTLRSPLGDRLNVEVDTAPTVDLNQVLNE

SEQ ID NO: 3046 - protein, 30 aa, Artificial
  Consensus peptide
VNTLRCQLGDRLNVEVDAAPTVDLNRVLNE

SEQ ID NO: 3047 - protein, 30 aa, Artificial
  Consensus peptide
VNTLRSQLGDRLNVEVDAAPTVDLNRVLNE

SEQ ID NO: 3048 - protein, 30 aa, Artificial
  Consensus peptide
VNTLRCPLGDRLNVEVDAAPTVDLNRVLNE

SEQ ID NO: 3049 - protein, 30 aa, Artificial
  Consensus peptide
VNTLRSPLGDRLNVEVDAAPTVDLNRVLNE

SEQ ID NO: 3050 - protein, 30 aa, Artificial
  Consensus peptide
VNTLRCQLGDRLNVEVDTAPTVDLNRVLNE

SEQ ID NO: 3051 - protein, 30 aa, Artificial
  Consensus peptide
VNTLRSQLGDRLNVEVDTAPTVDLNRVLNE

SEQ ID NO: 3052 - protein, 30 aa, Artificial
  Consensus peptide
VNTLRCPLGDRLNVEVDTAPTVDLNRVLNE

SEQ ID NO: 3053 - protein, 30 aa, Artificial
  Consensus peptide
VNTLRSPLGDRLNVEVDTAPTVDLNRVLNE

SEQ ID NO: 3054 - protein, 30 aa, Artificial
  Consensus peptide
NTLRCQLGDRLNVEVDAAPTVDLNQVLNET

SEQ ID NO: 3055 - protein, 30 aa, Artificial
  Consensus peptide
NTLRSQLGDRLNVEVDAAPTVDLNQVLNET

SEQ ID NO: 3056 - protein, 30 aa, Artificial
  Consensus peptide
NTLRCPLGDRLNVEVDAAPTVDLNQVLNET

SEQ ID NO: 3057 - protein, 30 aa, Artificial
  Consensus peptide
NTLRSPLGDRLNVEVDAAPTVDLNQVLNET

SEQ ID NO: 3058 - protein, 30 aa, Artificial
  Consensus peptide
NTLRCQLGDRLNVEVDTAPTVDLNQVLNET

SEQ ID NO: 3059 - protein, 30 aa, Artificial
  Consensus peptide
NTLRSQLGDRLNVEVDTAPTVDLNQVLNET

SEQ ID NO: 3060 - protein, 30 aa, Artificial
  Consensus peptide
NTLRCPLGDRLNVEVDTAPTVDLNQVLNET

SEQ ID NO: 3061 - protein, 30 aa, Artificial
  Consensus peptide
NTLRSPLGDRLNVEVDTAPTVDLNQVLNET

SEQ ID NO: 3062 - protein, 30 aa, Artificial
  Consensus peptide
NTLRCQLGDRLNVEVDAAPTVDLNRVLNET

SEQ ID NO: 3063 - protein, 30 aa, Artificial
  Consensus peptide
NTLRSQLGDRLNVEVDAAPTVDLNRVLNET

SEQ ID NO: 3064 - protein, 30 aa, Artificial
  Consensus peptide
NTLRCPLGDRLNVEVDAAPTVDLNRVLNET

SEQ ID NO: 3065 - protein, 30 aa, Artificial
  Consensus peptide
NTLRSPLGDRLNVEVDAAPTVDLNRVLNET

SEQ ID NO: 3066 - protein, 30 aa, Artificial
  Consensus peptide
NTLRCQLGDRLNVEVDTAPTVDLNRVLNET

SEQ ID NO: 3067 - protein, 30 aa, Artificial
  Consensus peptide
NTLRSQLGDRLNVEVDTAPTVDLNRVLNET

SEQ ID NO: 3068 - protein, 30 aa, Artificial
  Consensus peptide
NTLRCPLGDRLNVEVDTAPTVDLNRVLNET

SEQ ID NO: 3069 - protein, 30 aa, Artificial
  Consensus peptide
NTLRSPLGDRLNVEVDTAPTVDLNRVLNET

SEQ ID NO: 3070 - protein, 30 aa, Artificial
  Consensus peptide
TLRCQLGDRLNVEVDAAPTVDLNQVLNETR

SEQ ID NO: 3071 - protein, 30 aa, Artificial
  Consensus peptide
TLRSQLGDRLNVEVDAAPTVDLNQVLNETR

SEQ ID NO: 3072 - protein, 30 aa, Artificial
  Consensus peptide
TLRCPLGDRLNVEVDAAPTVDLNQVLNETR

SEQ ID NO: 3073 - protein, 30 aa, Artificial
  Consensus peptide
TLRSPLGDRLNVEVDAAPTVDLNQVLNETR

SEQ ID NO: 3074 - protein, 30 aa, Artificial
  Consensus peptide
TLRCQLGDRLNVEVDTAPTVDLNQVLNETR

SEQ ID NO: 3075 - protein, 30 aa, Artificial
  Consensus peptide
TLRSQLGDRLNVEVDTAPTVDLNQVLNETR

SEQ ID NO: 3076 - protein, 30 aa, Artificial
  Consensus peptide
TLRCPLGDRLNVEVDTAPTVDLNQVLNETR

SEQ ID NO: 3077 - protein, 30 aa, Artificial
  Consensus peptide
TLRSPLGDRLNVEVDTAPTVDLNQVLNETR

SEQ ID NO: 3078 - protein, 30 aa, Artificial
  Consensus peptide
TLRCQLGDRLNVEVDAAPTVDLNRVLNETR

SEQ ID NO: 3079 - protein, 30 aa, Artificial
  Consensus peptide
TLRSQLGDRLNVEVDAAPTVDLNRVLNETR

SEQ ID NO: 3080 - protein, 30 aa, Artificial
  Consensus peptide
TLRCPLGDRLNVEVDAAPTVDLNRVLNETR

SEQ ID NO: 3081 - protein, 30 aa, Artificial
  Consensus peptide
TLRSPLGDRLNVEVDAAPTVDLNRVLNETR

SEQ ID NO: 3082 - protein, 30 aa, Artificial
  Consensus peptide
TLRCQLGDRLNVEVDTAPTVDLNRVLNETR

SEQ ID NO: 3083 - protein, 30 aa, Artificial
  Consensus peptide
TLRSQLGDRLNVEVDTAPTVDLNRVLNETR

SEQ ID NO: 3084 - protein, 30 aa, Artificial
  Consensus peptide
TLRCPLGDRLNVEVDTAPTVDLNRVLNETR

SEQ ID NO: 3085 - protein, 30 aa, Artificial
  Consensus peptide
TLRSPLGDRLNVEVDTAPTVDLNRVLNETR

SEQ ID NO: 3086 - protein, 30 aa, Artificial
  Consensus peptide
LRCQLGDRLNVEVDAAPTVDLNQVLNETRS

SEQ ID NO: 3087 - protein, 30 aa, Artificial
  Consensus peptide
LRSQLGDRLNVEVDAAPTVDLNQVLNETRS

SEQ ID NO: 3088 - protein, 30 aa, Artificial
  Consensus peptide
LRCPLGDRLNVEVDAAPTVDLNQVLNETRS

SEQ ID NO: 3089 - protein, 30 aa, Artificial
  Consensus peptide
LRSPLGDRLNVEVDAAPTVDLNQVLNETRS

SEQ ID NO: 3090 - protein, 30 aa, Artificial
  Consensus peptide
LRCQLGDRLNVEVDTAPTVDLNQVLNETRS

SEQ ID NO: 3091 - protein, 30 aa, Artificial
  Consensus peptide
LRSQLGDRLNVEVDTAPTVDLNQVLNETRS

SEQ ID NO: 3092 - protein, 30 aa, Artificial
  Consensus peptide
LRCPLGDRLNVEVDTAPTVDLNQVLNETRS

SEQ ID NO: 3093 - protein, 30 aa, Artificial
  Consensus peptide
LRSPLGDRLNVEVDTAPTVDLNQVLNETRS

SEQ ID NO: 3094 - protein, 30 aa, Artificial
  Consensus peptide
LRCQLGDRLNVEVDAAPTVDLNRVLNETRS

SEQ ID NO: 3095 - protein, 30 aa, Artificial
  Consensus peptide
LRSQLGDRLNVEVDAAPTVDLNRVLNETRS

SEQ ID NO: 3096 - protein, 30 aa, Artificial
  Consensus peptide
LRCPLGDRLNVEVDAAPTVDLNRVLNETRS

SEQ ID NO: 3097 - protein, 30 aa, Artificial
  Consensus peptide
LRSPLGDRLNVEVDAAPTVDLNRVLNETRS

SEQ ID NO: 3098 - protein, 30 aa, Artificial
  Consensus peptide
LRCQLGDRLNVEVDTAPTVDLNRVLNETRS

SEQ ID NO: 3099 - protein, 30 aa, Artificial
  Consensus peptide
LRSQLGDRLNVEVDTAPTVDLNRVLNETRS

SEQ ID NO: 3100 - protein, 30 aa, Artificial
  Consensus peptide
LRCPLGDRLNVEVDTAPTVDLNRVLNETRS

SEQ ID NO: 3101 - protein, 30 aa, Artificial
  Consensus peptide
LRSPLGDRLNVEVDTAPTVDLNRVLNETRS

SEQ ID NO: 3102 - protein, 30 aa, Artificial
  Consensus peptide
LRCQLGDRLNVEVDAAPTVDLNQVLNETRN

SEQ ID NO: 3103 - protein, 30 aa, Artificial
  Consensus peptide
LRSQLGDRLNVEVDAAPTVDLNQVLNETRN

SEQ ID NO: 3104 - protein, 30 aa, Artificial
  Consensus peptide
LRCPLGDRLNVEVDAAPTVDLNQVLNETRN

SEQ ID NO: 3105 - protein, 30 aa, Artificial
  Consensus peptide
LRSPLGDRLNVEVDAAPTVDLNQVLNETRN

SEQ ID NO: 3106 - protein, 30 aa, Artificial
  Consensus peptide
LRCQLGDRLNVEVDTAPTVDLNQVLNETRN

SEQ ID NO: 3107 - protein, 30 aa, Artificial
  Consensus peptide
LRSQLGDRLNVEVDTAPTVDLNQVLNETRN

SEQ ID NO: 3108 - protein, 30 aa, Artificial
  Consensus peptide
LRCPLGDRLNVEVDTAPTVDLNQVLNETRN

SEQ ID NO: 3109 - protein, 30 aa, Artificial
  Consensus peptide
LRSPLGDRLNVEVDTAPTVDLNQVLNETRN

SEQ ID NO: 3110 - protein, 30 aa, Artificial
  Consensus peptide
LRCQLGDRLNVEVDAAPTVDLNRVLNETRN

SEQ ID NO: 3111 - protein, 30 aa, Artificial
  Consensus peptide
LRSQLGDRLNVEVDAAPTVDLNRVLNETRN

SEQ ID NO: 3112 - protein, 30 aa, Artificial
  Consensus peptide
LRCPLGDRLNVEVDAAPTVDLNRVLNETRN

SEQ ID NO: 3113 - protein, 30 aa, Artificial
  Consensus peptide
LRSPLGDRLNVEVDAAPTVDLNRVLNETRN

SEQ ID NO: 3114 - protein, 30 aa, Artificial
  Consensus peptide
LRCQLGDRLNVEVDTAPTVDLNRVLNETRN

SEQ ID NO: 3115 - protein, 30 aa, Artificial
  Consensus peptide
LRSQLGDRLNVEVDTAPTVDLNRVLNETRN

SEQ ID NO: 3116 - protein, 30 aa, Artificial
  Consensus peptide
LRCPLGDRLNVEVDTAPTVDLNRVLNETRN

SEQ ID NO: 3117 - protein, 30 aa, Artificial
  Consensus peptide
LRSPLGDRLNVEVDTAPTVDLNRVLNETRN

SEQ ID NO: 3118 - protein, 30 aa, Artificial
  Consensus peptide
RCQLGDRLNVEVDAAPTVDLNQVLNETRSQ

SEQ ID NO: 3119 - protein, 30 aa, Artificial
  Consensus peptide
RSQLGDRLNVEVDAAPTVDLNQVLNETRSQ

SEQ ID NO: 3120 - protein, 30 aa, Artificial
  Consensus peptide
RCPLGDRLNVEVDAAPTVDLNQVLNETRSQ

SEQ ID NO: 3121 - protein, 30 aa, Artificial
  Consensus peptide
RSPLGDRLNVEVDAAPTVDLNQVLNETRSQ

SEQ ID NO: 3122 - protein, 30 aa, Artificial
  Consensus peptide
RCQLGDRLNVEVDTAPTVDLNQVLNETRSQ

SEQ ID NO: 3123 - protein, 30 aa, Artificial
  Consensus peptide
RSQLGDRLNVEVDTAPTVDLNQVLNETRSQ

SEQ ID NO: 3124 - protein, 30 aa, Artificial
  Consensus peptide
RCPLGDRLNVEVDTAPTVDLNQVLNETRSQ

SEQ ID NO: 3125 - protein, 30 aa, Artificial
  Consensus peptide
RSPLGDRLNVEVDTAPTVDLNQVLNETRSQ

SEQ ID NO: 3126 - protein, 30 aa, Artificial
  Consensus peptide
RCQLGDRLNVEVDAAPTVDLNRVLNETRSQ

SEQ ID NO: 3127 - protein, 30 aa, Artificial
  Consensus peptide
RSQLGDRLNVEVDAAPTVDLNRVLNETRSQ

SEQ ID NO: 3128 - protein, 30 aa, Artificial
  Consensus peptide
RCPLGDRLNVEVDAAPTVDLNRVLNETRSQ

SEQ ID NO: 3129 - protein, 30 aa, Artificial
  Consensus peptide
RSPLGDRLNVEVDAAPTVDLNRVLNETRSQ

SEQ ID NO: 3130 - protein, 30 aa, Artificial
  Consensus peptide
RCQLGDRLNVEVDTAPTVDLNRVLNETRSQ

SEQ ID NO: 3131 - protein, 30 aa, Artificial
  Consensus peptide
RSQLGDRLNVEVDTAPTVDLNRVLNETRSQ

SEQ ID NO: 3132 - protein, 30 aa, Artificial
  Consensus peptide
RCPLGDRLNVEVDTAPTVDLNRVLNETRSQ

SEQ ID NO: 3133 - protein, 30 aa, Artificial
  Consensus peptide
RSPLGDRLNVEVDTAPTVDLNRVLNETRSQ

SEQ ID NO: 3134 - protein, 30 aa, Artificial
  Consensus peptide
RCQLGDRLNVEVDAAPTVDLNQVLNETRNQ

SEQ ID NO: 3135 - protein, 30 aa, Artificial
  Consensus peptide
RSQLGDRLNVEVDAAPTVDLNQVLNETRNQ

SEQ ID NO: 3136 - protein, 30 aa, Artificial
  Consensus peptide
RCPLGDRLNVEVDAAPTVDLNQVLNETRNQ

SEQ ID NO: 3137 - protein, 30 aa, Artificial
  Consensus peptide
RSPLGDRLNVEVDAAPTVDLNQVLNETRNQ

SEQ ID NO: 3138 - protein, 30 aa, Artificial
  Consensus peptide
RCQLGDRLNVEVDTAPTVDLNQVLNETRNQ

SEQ ID NO: 3139 - protein, 30 aa, Artificial
  Consensus peptide
RSQLGDRLNVEVDTAPTVDLNQVLNETRNQ

SEQ ID NO: 3140 - protein, 30 aa, Artificial
  Consensus peptide
RCPLGDRLNVEVDTAPTVDLNQVLNETRNQ

SEQ ID NO: 3141 - protein, 30 aa, Artificial
  Consensus peptide
RSPLGDRLNVEVDTAPTVDLNQVLNETRNQ

SEQ ID NO: 3142 - protein, 30 aa, Artificial
  Consensus peptide
RCQLGDRLNVEVDAAPTVDLNRVLNETRNQ

SEQ ID NO: 3143 - protein, 30 aa, Artificial
  Consensus peptide
RSQLGDRLNVEVDAAPTVDLNRVLNETRNQ

SEQ ID NO: 3144 - protein, 30 aa, Artificial
  Consensus peptide
RCPLGDRLNVEVDAAPTVDLNRVLNETRNQ

SEQ ID NO: 3145 - protein, 30 aa, Artificial
  Consensus peptide
RSPLGDRLNVEVDAAPTVDLNRVLNETRNQ

SEQ ID NO: 3146 - protein, 30 aa, Artificial
  Consensus peptide
RCQLGDRLNVEVDTAPTVDLNRVLNETRNQ

SEQ ID NO: 3147 - protein, 30 aa, Artificial
  Consensus peptide
RSQLGDRLNVEVDTAPTVDLNRVLNETRNQ

SEQ ID NO: 3148 - protein, 30 aa, Artificial
  Consensus peptide
RCPLGDRLNVEVDTAPTVDLNRVLNETRNQ

SEQ ID NO: 3149 - protein, 30 aa, Artificial
  Consensus peptide
RSPLGDRLNVEVDTAPTVDLNRVLNETRNQ

SEQ ID NO: 3150 - protein, 30 aa, Artificial
  Consensus peptide
CQLGDRLNVEVDAAPTVDLNQVLNETRSQY

SEQ ID NO: 3151 - protein, 30 aa, Artificial
  Consensus peptide
SQLGDRLNVEVDAAPTVDLNQVLNETRSQY

SEQ ID NO: 3152 - protein, 30 aa, Artificial
  Consensus peptide
CPLGDRLNVEVDAAPTVDLNQVLNETRSQY

SEQ ID NO: 3153 - protein, 30 aa, Artificial
  Consensus peptide
SPLGDRLNVEVDAAPTVDLNQVLNETRSQY

SEQ ID NO: 3154 - protein, 30 aa, Artificial
  Consensus peptide
CQLGDRLNVEVDTAPTVDLNQVLNETRSQY

SEQ ID NO: 3155 - protein, 30 aa, Artificial
  Consensus peptide
SQLGDRLNVEVDTAPTVDLNQVLNETRSQY

SEQ ID NO: 3156 - protein, 30 aa, Artificial
  Consensus peptide
CPLGDRLNVEVDTAPTVDLNQVLNETRSQY

SEQ ID NO: 3157 - protein, 30 aa, Artificial
  Consensus peptide
SPLGDRLNVEVDTAPTVDLNQVLNETRSQY

SEQ ID NO: 3158 - protein, 30 aa, Artificial
  Consensus peptide
CQLGDRLNVEVDAAPTVDLNRVLNETRSQY

SEQ ID NO: 3159 - protein, 30 aa, Artificial
  Consensus peptide
SQLGDRLNVEVDAAPTVDLNRVLNETRSQY

SEQ ID NO: 3160 - protein, 30 aa, Artificial
  Consensus peptide
CPLGDRLNVEVDAAPTVDLNRVLNETRSQY

SEQ ID NO: 3161 - protein, 30 aa, Artificial
  Consensus peptide
SPLGDRLNVEVDAAPTVDLNRVLNETRSQY

SEQ ID NO: 3162 - protein, 30 aa, Artificial
  Consensus peptide
CQLGDRLNVEVDTAPTVDLNRVLNETRSQY

SEQ ID NO: 3163 - protein, 30 aa, Artificial
  Consensus peptide
SQLGDRLNVEVDTAPTVDLNRVLNETRSQY

SEQ ID NO: 3164 - protein, 30 aa, Artificial
  Consensus peptide
CPLGDRLNVEVDTAPTVDLNRVLNETRSQY

SEQ ID NO: 3165 - protein, 30 aa, Artificial
  Consensus peptide
SPLGDRLNVEVDTAPTVDLNRVLNETRSQY

SEQ ID NO: 3166 - protein, 30 aa, Artificial
  Consensus peptide
CQLGDRLNVEVDAAPTVDLNQVLNETRNQY

SEQ ID NO: 3167 - protein, 30 aa, Artificial
  Consensus peptide
SQLGDRLNVEVDAAPTVDLNQVLNETRNQY

SEQ ID NO: 3168 - protein, 30 aa, Artificial
  Consensus peptide
CPLGDRLNVEVDAAPTVDLNQVLNETRNQY

SEQ ID NO: 3169 - protein, 30 aa, Artificial
  Consensus peptide
SPLGDRLNVEVDAAPTVDLNQVLNETRNQY

SEQ ID NO: 3170 - protein, 30 aa, Artificial
  Consensus peptide
CQLGDRLNVEVDTAPTVDLNQVLNETRNQY

SEQ ID NO: 3171 - protein, 30 aa, Artificial
  Consensus peptide
SQLGDRLNVEVDTAPTVDLNQVLNETRNQY

SEQ ID NO: 3172 - protein, 30 aa, Artificial
  Consensus peptide
CPLGDRLNVEVDTAPTVDLNQVLNETRNQY

SEQ ID NO: 3173 - protein, 30 aa, Artificial
  Consensus peptide
SPLGDRLNVEVDTAPTVDLNQVLNETRNQY

SEQ ID NO: 3174 - protein, 30 aa, Artificial
  Consensus peptide
CQLGDRLNVEVDAAPTVDLNRVLNETRNQY

SEQ ID NO: 3175 - protein, 30 aa, Artificial
  Consensus peptide
SQLGDRLNVEVDAAPTVDLNRVLNETRNQY

SEQ ID NO: 3176 - protein, 30 aa, Artificial
  Consensus peptide
CPLGDRLNVEVDAAPTVDLNRVLNETRNQY

SEQ ID NO: 3177 - protein, 30 aa, Artificial
  Consensus peptide
SPLGDRLNVEVDAAPTVDLNRVLNETRNQY

SEQ ID NO: 3178 - protein, 30 aa, Artificial
  Consensus peptide
CQLGDRLNVEVDTAPTVDLNRVLNETRNQY

SEQ ID NO: 3179 - protein, 30 aa, Artificial
  Consensus peptide
SQLGDRLNVEVDTAPTVDLNRVLNETRNQY

SEQ ID NO: 3180 - protein, 30 aa, Artificial
  Consensus peptide
CPLGDRLNVEVDTAPTVDLNRVLNETRNQY

SEQ ID NO: 3181 - protein, 30 aa, Artificial
  Consensus peptide
SPLGDRLNVEVDTAPTVDLNRVLNETRNQY

SEQ ID NO: 3182 - protein, 30 aa, Artificial
  Consensus peptide
QLGDRLNVEVDAAPTVDLNQVLNETRSQYE

SEQ ID NO: 3183 - protein, 30 aa, Artificial
  Consensus peptide
PLGDRLNVEVDAAPTVDLNQVLNETRSQYE

SEQ ID NO: 3184 - protein, 30 aa, Artificial
  Consensus peptide
QLGDRLNVEVDTAPTVDLNQVLNETRSQYE

SEQ ID NO: 3185 - protein, 30 aa, Artificial
  Consensus peptide
PLGDRLNVEVDTAPTVDLNQVLNETRSQYE

SEQ ID NO: 3186 - protein, 30 aa, Artificial
  Consensus peptide
QLGDRLNVEVDAAPTVDLNRVLNETRSQYE

SEQ ID NO: 3187 - protein, 30 aa, Artificial
  Consensus peptide
PLGDRLNVEVDAAPTVDLNRVLNETRSQYE

SEQ ID NO: 3188 - protein, 30 aa, Artificial
  Consensus peptide
QLGDRLNVEVDTAPTVDLNRVLNETRSQYE

SEQ ID NO: 3189 - protein, 30 aa, Artificial
  Consensus peptide
PLGDRLNVEVDTAPTVDLNRVLNETRSQYE

SEQ ID NO: 3190 - protein, 30 aa, Artificial
  Consensus peptide
QLGDRLNVEVDAAPTVDLNQVLNETRNQYE

SEQ ID NO: 3191 - protein, 30 aa, Artificial
  Consensus peptide
PLGDRLNVEVDAAPTVDLNQVLNETRNQYE

SEQ ID NO: 3192 - protein, 30 aa, Artificial
  Consensus peptide
QLGDRLNVEVDTAPTVDLNQVLNETRNQYE

SEQ ID NO: 3193 - protein, 30 aa, Artificial
  Consensus peptide
PLGDRLNVEVDTAPTVDLNQVLNETRNQYE

SEQ ID NO: 3194 - protein, 30 aa, Artificial
  Consensus peptide
QLGDRLNVEVDAAPTVDLNRVLNETRNQYE

SEQ ID NO: 3195 - protein, 30 aa, Artificial
  Consensus peptide
PLGDRLNVEVDAAPTVDLNRVLNETRNQYE

SEQ ID NO: 3196 - protein, 30 aa, Artificial
  Consensus peptide
QLGDRLNVEVDTAPTVDLNRVLNETRNQYE

SEQ ID NO: 3197 - protein, 30 aa, Artificial
  Consensus peptide
PLGDRLNVEVDTAPTVDLNRVLNETRNQYE

SEQ ID NO: 3198 - protein, 30 aa, Artificial
  Consensus peptide
LGDRLNVEVDAAPTVDLNQVLNETRSQYEA

SEQ ID NO: 3199 - protein, 30 aa, Artificial
  Consensus peptide
LGDRLNVEVDTAPTVDLNQVLNETRSQYEA

SEQ ID NO: 3200 - protein, 30 aa, Artificial
  Consensus peptide
LGDRLNVEVDAAPTVDLNRVLNETRSQYEA

SEQ ID NO: 3201 - protein, 30 aa, Artificial
  Consensus peptide
LGDRLNVEVDTAPTVDLNRVLNETRSQYEA

SEQ ID NO: 3202 - protein, 30 aa, Artificial
  Consensus peptide
LGDRLNVEVDAAPTVDLNQVLNETRNQYEA

SEQ ID NO: 3203 - protein, 30 aa, Artificial
  Consensus peptide
LGDRLNVEVDTAPTVDLNQVLNETRNQYEA

SEQ ID NO: 3204 - protein, 30 aa, Artificial
  Consensus peptide
LGDRLNVEVDAAPTVDLNRVLNETRNQYEA

SEQ ID NO: 3205 - protein, 30 aa, Artificial
  Consensus peptide
LGDRLNVEVDTAPTVDLNRVLNETRNQYEA

SEQ ID NO: 3206 - protein, 30 aa, Artificial
  Consensus peptide
GDRLNVEVDAAPTVDLNQVLNETRSQYEAL

SEQ ID NO: 3207 - protein, 30 aa, Artificial
  Consensus peptide
GDRLNVEVDTAPTVDLNQVLNETRSQYEAL

SEQ ID NO: 3208 - protein, 30 aa, Artificial
  Consensus peptide
GDRLNVEVDAAPTVDLNRVLNETRSQYEAL

SEQ ID NO: 3209 - protein, 30 aa, Artificial
  Consensus peptide
GDRLNVEVDTAPTVDLNRVLNETRSQYEAL

SEQ ID NO: 3210 - protein, 30 aa, Artificial
  Consensus peptide
GDRLNVEVDAAPTVDLNQVLNETRNQYEAL

SEQ ID NO: 3211 - protein, 30 aa, Artificial
  Consensus peptide
GDRLNVEVDTAPTVDLNQVLNETRNQYEAL

SEQ ID NO: 3212 - protein, 30 aa, Artificial
  Consensus peptide
GDRLNVEVDAAPTVDLNRVLNETRNQYEAL

SEQ ID NO: 3213 - protein, 30 aa, Artificial
  Consensus peptide
GDRLNVEVDTAPTVDLNRVLNETRNQYEAL

SEQ ID NO: 3214 - protein, 31 aa, Artificial
  Consensus peptide
EVNTLRCQLGDRLNVEVDAAPTVDLNQVLNE

SEQ ID NO: 3215 - protein, 31 aa, Artificial
  Consensus peptide
EVNTLRSQLGDRLNVEVDAAPTVDLNQVLNE

SEQ ID NO: 3216 - protein, 31 aa, Artificial
  Consensus peptide
EVNTLRCPLGDRLNVEVDAAPTVDLNQVLNE

SEQ ID NO: 3217 - protein, 31 aa, Artificial
  Consensus peptide
EVNTLRSPLGDRLNVEVDAAPTVDLNQVLNE

SEQ ID NO: 3218 - protein, 31 aa, Artificial
  Consensus peptide
EVNTLRCQLGDRLNVEVDTAPTVDLNQVLNE

SEQ ID NO: 3219 - protein, 31 aa, Artificial
  Consensus peptide
EVNTLRSQLGDRLNVEVDTAPTVDLNQVLNE

SEQ ID NO: 3220 - protein, 31 aa, Artificial
  Consensus peptide
EVNTLRCPLGDRLNVEVDTAPTVDLNQVLNE

SEQ ID NO: 3221 - protein, 31 aa, Artificial
  Consensus peptide
EVNTLRSPLGDRLNVEVDTAPTVDLNQVLNE

SEQ ID NO: 3222 - protein, 31 aa, Artificial
  Consensus peptide
EVNTLRCQLGDRLNVEVDAAPTVDLNRVLNE

SEQ ID NO: 3223 - protein, 31 aa, Artificial
  Consensus peptide
EVNTLRSQLGDRLNVEVDAAPTVDLNRVLNE

SEQ ID NO: 3224 - protein, 31 aa, Artificial
  Consensus peptide
EVNTLRCPLGDRLNVEVDAAPTVDLNRVLNE

SEQ ID NO: 3225 - protein, 31 aa, Artificial
  Consensus peptide
EVNTLRSPLGDRLNVEVDAAPTVDLNRVLNE

SEQ ID NO: 3226 - protein, 31 aa, Artificial
  Consensus peptide
EVNTLRCQLGDRLNVEVDTAPTVDLNRVLNE

SEQ ID NO: 3227 - protein, 31 aa, Artificial
  Consensus peptide
EVNTLRSQLGDRLNVEVDTAPTVDLNRVLNE

SEQ ID NO: 3228 - protein, 31 aa, Artificial
  Consensus peptide
EVNTLRCPLGDRLNVEVDTAPTVDLNRVLNE

SEQ ID NO: 3229 - protein, 31 aa, Artificial
  Consensus peptide
EVNTLRSPLGDRLNVEVDTAPTVDLNRVLNE

SEQ ID NO: 3230 - protein, 31 aa, Artificial
  Consensus peptide
VNTLRCQLGDRLNVEVDAAPTVDLNQVLNET

SEQ ID NO: 3231 - protein, 31 aa, Artificial
  Consensus peptide
VNTLRSQLGDRLNVEVDAAPTVDLNQVLNET

SEQ ID NO: 3232 - protein, 31 aa, Artificial
  Consensus peptide
VNTLRCPLGDRLNVEVDAAPTVDLNQVLNET

SEQ ID NO: 3233 - protein, 31 aa, Artificial
  Consensus peptide
VNTLRSPLGDRLNVEVDAAPTVDLNQVLNET

SEQ ID NO: 3234 - protein, 31 aa, Artificial
  Consensus peptide
VNTLRCQLGDRLNVEVDTAPTVDLNQVLNET

SEQ ID NO: 3235 - protein, 31 aa, Artificial
  Consensus peptide
VNTLRSQLGDRLNVEVDTAPTVDLNQVLNET

SEQ ID NO: 3236 - protein, 31 aa, Artificial
  Consensus peptide
VNTLRCPLGDRLNVEVDTAPTVDLNQVLNET

SEQ ID NO: 3237 - protein, 31 aa, Artificial
  Consensus peptide
VNTLRSPLGDRLNVEVDTAPTVDLNQVLNET

SEQ ID NO: 3238 - protein, 31 aa, Artificial
  Consensus peptide
VNTLRCQLGDRLNVEVDAAPTVDLNRVLNET

SEQ ID NO: 3239 - protein, 31 aa, Artificial
  Consensus peptide
VNTLRSQLGDRLNVEVDAAPTVDLNRVLNET

SEQ ID NO: 3240 - protein, 31 aa, Artificial
  Consensus peptide
VNTLRCPLGDRLNVEVDAAPTVDLNRVLNET

SEQ ID NO: 3241 - protein, 31 aa, Artificial
  Consensus peptide
VNTLRSPLGDRLNVEVDAAPTVDLNRVLNET

SEQ ID NO: 3242 - protein, 31 aa, Artificial
  Consensus peptide
VNTLRCQLGDRLNVEVDTAPTVDLNRVLNET

SEQ ID NO: 3243 - protein, 31 aa, Artificial
  Consensus peptide
VNTLRSQLGDRLNVEVDTAPTVDLNRVLNET

SEQ ID NO: 3244 - protein, 31 aa, Artificial
  Consensus peptide
VNTLRCPLGDRLNVEVDTAPTVDLNRVLNET

SEQ ID NO: 3245 - protein, 31 aa, Artificial
  Consensus peptide
VNTLRSPLGDRLNVEVDTAPTVDLNRVLNET

SEQ ID NO: 3246 - protein, 31 aa, Artificial
  Consensus peptide
NTLRCQLGDRLNVEVDAAPTVDLNQVLNETR

SEQ ID NO: 3247 - protein, 31 aa, Artificial
  Consensus peptide
NTLRSQLGDRLNVEVDAAPTVDLNQVLNETR

SEQ ID NO: 3248 - protein, 31 aa, Artificial
  Consensus peptide
NTLRCPLGDRLNVEVDAAPTVDLNQVLNETR

SEQ ID NO: 3249 - protein, 31 aa, Artificial
  Consensus peptide
NTLRSPLGDRLNVEVDAAPTVDLNQVLNETR

SEQ ID NO: 3250 - protein, 31 aa, Artificial
  Consensus peptide
NTLRCQLGDRLNVEVDTAPTVDLNQVLNETR

SEQ ID NO: 3251 - protein, 31 aa, Artificial
  Consensus peptide
NTLRSQLGDRLNVEVDTAPTVDLNQVLNETR

SEQ ID NO: 3252 - protein, 31 aa, Artificial
  Consensus peptide
NTLRCPLGDRLNVEVDTAPTVDLNQVLNETR

SEQ ID NO: 3253 - protein, 31 aa, Artificial
  Consensus peptide
NTLRSPLGDRLNVEVDTAPTVDLNQVLNETR

SEQ ID NO: 3254 - protein, 31 aa, Artificial
  Consensus peptide
NTLRCQLGDRLNVEVDAAPTVDLNRVLNETR

SEQ ID NO: 3255 - protein, 31 aa, Artificial
  Consensus peptide
NTLRSQLGDRLNVEVDAAPTVDLNRVLNETR

SEQ ID NO: 3256 - protein, 31 aa, Artificial
  Consensus peptide
NTLRCPLGDRLNVEVDAAPTVDLNRVLNETR

SEQ ID NO: 3257 - protein, 31 aa, Artificial
  Consensus peptide
NTLRSPLGDRLNVEVDAAPTVDLNRVLNETR

SEQ ID NO: 3258 - protein, 31 aa, Artificial
  Consensus peptide
NTLRCQLGDRLNVEVDTAPTVDLNRVLNETR

SEQ ID NO: 3259 - protein, 31 aa, Artificial
  Consensus peptide
NTLRSQLGDRLNVEVDTAPTVDLNRVLNETR

SEQ ID NO: 3260 - protein, 31 aa, Artificial
  Consensus peptide
NTLRCPLGDRLNVEVDTAPTVDLNRVLNETR

SEQ ID NO: 3261 - protein, 31 aa, Artificial
  Consensus peptide
NTLRSPLGDRLNVEVDTAPTVDLNRVLNETR

SEQ ID NO: 3262 - protein, 31 aa, Artificial
  Consensus peptide
TLRCQLGDRLNVEVDAAPTVDLNQVLNETRS

SEQ ID NO: 3263 - protein, 31 aa, Artificial
  Consensus peptide
TLRSQLGDRLNVEVDAAPTVDLNQVLNETRS

SEQ ID NO: 3264 - protein, 31 aa, Artificial
  Consensus peptide
TLRCPLGDRLNVEVDAAPTVDLNQVLNETRS

SEQ ID NO: 3265 - protein, 31 aa, Artificial
  Consensus peptide
TLRSPLGDRLNVEVDAAPTVDLNQVLNETRS

SEQ ID NO: 3266 - protein, 31 aa, Artificial
  Consensus peptide
TLRCQLGDRLNVEVDTAPTVDLNQVLNETRS

SEQ ID NO: 3267 - protein, 31 aa, Artificial
  Consensus peptide
TLRSQLGDRLNVEVDTAPTVDLNQVLNETRS

SEQ ID NO: 3268 - protein, 31 aa, Artificial
  Consensus peptide
TLRCPLGDRLNVEVDTAPTVDLNQVLNETRS

SEQ ID NO: 3269 - protein, 31 aa, Artificial
  Consensus peptide
TLRSPLGDRLNVEVDTAPTVDLNQVLNETRS

SEQ ID NO: 3270 - protein, 31 aa, Artificial
  Consensus peptide
TLRCQLGDRLNVEVDAAPTVDLNRVLNETRS

SEQ ID NO: 3271 - protein, 31 aa, Artificial
  Consensus peptide
TLRSQLGDRLNVEVDAAPTVDLNRVLNETRS

SEQ ID NO: 3272 - protein, 31 aa, Artificial
  Consensus peptide
TLRCPLGDRLNVEVDAAPTVDLNRVLNETRS

SEQ ID NO: 3273 - protein, 31 aa, Artificial
  Consensus peptide
TLRSPLGDRLNVEVDAAPTVDLNRVLNETRS

SEQ ID NO: 3274 - protein, 31 aa, Artificial
  Consensus peptide
TLRCQLGDRLNVEVDTAPTVDLNRVLNETRS

SEQ ID NO: 3275 - protein, 31 aa, Artificial
  Consensus peptide
TLRSQLGDRLNVEVDTAPTVDLNRVLNETRS

SEQ ID NO: 3276 - protein, 31 aa, Artificial
  Consensus peptide
TLRCPLGDRLNVEVDTAPTVDLNRVLNETRS

SEQ ID NO: 3277 - protein, 31 aa, Artificial
  Consensus peptide
TLRSPLGDRLNVEVDTAPTVDLNRVLNETRS

SEQ ID NO: 3278 - protein, 31 aa, Artificial
  Consensus peptide
TLRCQLGDRLNVEVDAAPTVDLNQVLNETRN

SEQ ID NO: 3279 - protein, 31 aa, Artificial
  Consensus peptide
TLRSQLGDRLNVEVDAAPTVDLNQVLNETRN

SEQ ID NO: 3280 - protein, 31 aa, Artificial
  Consensus peptide
TLRCPLGDRLNVEVDAAPTVDLNQVLNETRN

SEQ ID NO: 3281 - protein, 31 aa, Artificial
  Consensus peptide
TLRSPLGDRLNVEVDAAPTVDLNQVLNETRN

SEQ ID NO: 3282 - protein, 31 aa, Artificial
  Consensus peptide
TLRCQLGDRLNVEVDTAPTVDLNQVLNETRN

SEQ ID NO: 3283 - protein, 31 aa, Artificial
  Consensus peptide
TLRSQLGDRLNVEVDTAPTVDLNQVLNETRN

SEQ ID NO: 3284 - protein, 31 aa, Artificial
  Consensus peptide
TLRCPLGDRLNVEVDTAPTVDLNQVLNETRN

SEQ ID NO: 3285 - protein, 31 aa, Artificial
  Consensus peptide
TLRSPLGDRLNVEVDTAPTVDLNQVLNETRN

SEQ ID NO: 3286 - protein, 31 aa, Artificial
  Consensus peptide
TLRCQLGDRLNVEVDAAPTVDLNRVLNETRN

SEQ ID NO: 3287 - protein, 31 aa, Artificial
  Consensus peptide
TLRSQLGDRLNVEVDAAPTVDLNRVLNETRN

SEQ ID NO: 3288 - protein, 31 aa, Artificial
  Consensus peptide
TLRCPLGDRLNVEVDAAPTVDLNRVLNETRN

SEQ ID NO: 3289 - protein, 31 aa, Artificial
  Consensus peptide
TLRSPLGDRLNVEVDAAPTVDLNRVLNETRN

SEQ ID NO: 3290 - protein, 31 aa, Artificial
  Consensus peptide
TLRCQLGDRLNVEVDTAPTVDLNRVLNETRN

SEQ ID NO: 3291 - protein, 31 aa, Artificial
  Consensus peptide
TLRSQLGDRLNVEVDTAPTVDLNRVLNETRN

SEQ ID NO: 3292 - protein, 31 aa, Artificial
  Consensus peptide
TLRCPLGDRLNVEVDTAPTVDLNRVLNETRN

SEQ ID NO: 3293 - protein, 31 aa, Artificial
  Consensus peptide
TLRSPLGDRLNVEVDTAPTVDLNRVLNETRN

SEQ ID NO: 3294 - protein, 31 aa, Artificial
  Consensus peptide
LRCQLGDRLNVEVDAAPTVDLNQVLNETRSQ

SEQ ID NO: 3295 - protein, 31 aa, Artificial
  Consensus peptide
LRSQLGDRLNVEVDAAPTVDLNQVLNETRSQ

SEQ ID NO: 3296 - protein, 31 aa, Artificial
  Consensus peptide
LRCPLGDRLNVEVDAAPTVDLNQVLNETRSQ

SEQ ID NO: 3297 - protein, 31 aa, Artificial
  Consensus peptide
LRSPLGDRLNVEVDAAPTVDLNQVLNETRSQ

SEQ ID NO: 3298 - protein, 31 aa, Artificial
  Consensus peptide
LRCQLGDRLNVEVDTAPTVDLNQVLNETRSQ

SEQ ID NO: 3299 - protein, 31 aa, Artificial
  Consensus peptide
LRSQLGDRLNVEVDTAPTVDLNQVLNETRSQ

SEQ ID NO: 3300 - protein, 31 aa, Artificial
  Consensus peptide
LRCPLGDRLNVEVDTAPTVDLNQVLNETRSQ

SEQ ID NO: 3301 - protein, 31 aa, Artificial
  Consensus peptide
LRSPLGDRLNVEVDTAPTVDLNQVLNETRSQ

SEQ ID NO: 3302 - protein, 31 aa, Artificial
  Consensus peptide
LRCQLGDRLNVEVDAAPTVDLNRVLNETRSQ

SEQ ID NO: 3303 - protein, 31 aa, Artificial
  Consensus peptide
LRSQLGDRLNVEVDAAPTVDLNRVLNETRSQ

SEQ ID NO: 3304 - protein, 31 aa, Artificial
  Consensus peptide
LRCPLGDRLNVEVDAAPTVDLNRVLNETRSQ

SEQ ID NO: 3305 - protein, 31 aa, Artificial
  Consensus peptide
LRSPLGDRLNVEVDAAPTVDLNRVLNETRSQ

SEQ ID NO: 3306 - protein, 31 aa, Artificial
  Consensus peptide
LRCQLGDRLNVEVDTAPTVDLNRVLNETRSQ

SEQ ID NO: 3307 - protein, 31 aa, Artificial
  Consensus peptide
LRSQLGDRLNVEVDTAPTVDLNRVLNETRSQ

SEQ ID NO: 3308 - protein, 31 aa, Artificial
  Consensus peptide
LRCPLGDRLNVEVDTAPTVDLNRVLNETRSQ

SEQ ID NO: 3309 - protein, 31 aa, Artificial
  Consensus peptide
LRSPLGDRLNVEVDTAPTVDLNRVLNETRSQ

SEQ ID NO: 3310 - protein, 31 aa, Artificial
  Consensus peptide
LRCQLGDRLNVEVDAAPTVDLNQVLNETRNQ

SEQ ID NO: 3311 - protein, 31 aa, Artificial
  Consensus peptide
LRSQLGDRLNVEVDAAPTVDLNQVLNETRNQ

SEQ ID NO: 3312 - protein, 31 aa, Artificial
  Consensus peptide
LRCPLGDRLNVEVDAAPTVDLNQVLNETRNQ

SEQ ID NO: 3313 - protein, 31 aa, Artificial
  Consensus peptide
LRSPLGDRLNVEVDAAPTVDLNQVLNETRNQ

SEQ ID NO: 3314 - protein, 31 aa, Artificial
  Consensus peptide
LRCQLGDRLNVEVDTAPTVDLNQVLNETRNQ

SEQ ID NO: 3315 - protein, 31 aa, Artificial
  Consensus peptide
LRSQLGDRLNVEVDTAPTVDLNQVLNETRNQ

SEQ ID NO: 3316 - protein, 31 aa, Artificial
  Consensus peptide
LRCPLGDRLNVEVDTAPTVDLNQVLNETRNQ

SEQ ID NO: 3317 - protein, 31 aa, Artificial
  Consensus peptide
LRSPLGDRLNVEVDTAPTVDLNQVLNETRNQ

SEQ ID NO: 3318 - protein, 31 aa, Artificial
  Consensus peptide
LRCQLGDRLNVEVDAAPTVDLNRVLNETRNQ

SEQ ID NO: 3319 - protein, 31 aa, Artificial
  Consensus peptide
LRSQLGDRLNVEVDAAPTVDLNRVLNETRNQ

SEQ ID NO: 3320 - protein, 31 aa, Artificial
  Consensus peptide
LRCPLGDRLNVEVDAAPTVDLNRVLNETRNQ

SEQ ID NO: 3321 - protein, 31 aa, Artificial
  Consensus peptide
LRSPLGDRLNVEVDAAPTVDLNRVLNETRNQ

SEQ ID NO: 3322 - protein, 31 aa, Artificial
  Consensus peptide
LRCQLGDRLNVEVDTAPTVDLNRVLNETRNQ

SEQ ID NO: 3323 - protein, 31 aa, Artificial
  Consensus peptide
LRSQLGDRLNVEVDTAPTVDLNRVLNETRNQ

SEQ ID NO: 3324 - protein, 31 aa, Artificial
  Consensus peptide
LRCPLGDRLNVEVDTAPTVDLNRVLNETRNQ

SEQ ID NO: 3325 - protein, 31 aa, Artificial
  Consensus peptide
LRSPLGDRLNVEVDTAPTVDLNRVLNETRNQ

SEQ ID NO: 3326 - protein, 31 aa, Artificial
  Consensus peptide
RCQLGDRLNVEVDAAPTVDLNQVLNETRSQY

SEQ ID NO: 3327 - protein, 31 aa, Artificial
  Consensus peptide
RSQLGDRLNVEVDAAPTVDLNQVLNETRSQY

SEQ ID NO: 3328 - protein, 31 aa, Artificial
  Consensus peptide
RCPLGDRLNVEVDAAPTVDLNQVLNETRSQY

SEQ ID NO: 3329 - protein, 31 aa, Artificial
  Consensus peptide
RSPLGDRLNVEVDAAPTVDLNQVLNETRSQY

SEQ ID NO: 3330 - protein, 31 aa, Artificial
  Consensus peptide
RCQLGDRLNVEVDTAPTVDLNQVLNETRSQY

SEQ ID NO: 3331 - protein, 31 aa, Artificial
  Consensus peptide
RSQLGDRLNVEVDTAPTVDLNQVLNETRSQY

SEQ ID NO: 3332 - protein, 31 aa, Artificial
  Consensus peptide
RCPLGDRLNVEVDTAPTVDLNQVLNETRSQY

SEQ ID NO: 3333 - protein, 31 aa, Artificial
  Consensus peptide
RSPLGDRLNVEVDTAPTVDLNQVLNETRSQY

SEQ ID NO: 3334 - protein, 31 aa, Artificial
  Consensus peptide
RCQLGDRLNVEVDAAPTVDLNRVLNETRSQY

SEQ ID NO: 3335 - protein, 31 aa, Artificial
  Consensus peptide
RSQLGDRLNVEVDAAPTVDLNRVLNETRSQY

SEQ ID NO: 3336 - protein, 31 aa, Artificial
  Consensus peptide
RCPLGDRLNVEVDAAPTVDLNRVLNETRSQY

SEQ ID NO: 3337 - protein, 31 aa, Artificial
  Consensus peptide
RSPLGDRLNVEVDAAPTVDLNRVLNETRSQY

SEQ ID NO: 3338 - protein, 31 aa, Artificial
  Consensus peptide
RCQLGDRLNVEVDTAPTVDLNRVLNETRSQY

SEQ ID NO: 3339 - protein, 31 aa, Artificial
  Consensus peptide
RSQLGDRLNVEVDTAPTVDLNRVLNETRSQY

SEQ ID NO: 3340 - protein, 31 aa, Artificial
  Consensus peptide
RCPLGDRLNVEVDTAPTVDLNRVLNETRSQY

SEQ ID NO: 3341 - protein, 31 aa, Artificial
  Consensus peptide
RSPLGDRLNVEVDTAPTVDLNRVLNETRSQY

SEQ ID NO: 3342 - protein, 31 aa, Artificial
  Consensus peptide
RCQLGDRLNVEVDAAPTVDLNQVLNETRNQY

SEQ ID NO: 3343 - protein, 31 aa, Artificial
  Consensus peptide
RSQLGDRLNVEVDAAPTVDLNQVLNETRNQY

SEQ ID NO: 3344 - protein, 31 aa, Artificial
  Consensus peptide
RCPLGDRLNVEVDAAPTVDLNQVLNETRNQY

SEQ ID NO: 3345 - protein, 31 aa, Artificial
  Consensus peptide
RSPLGDRLNVEVDAAPTVDLNQVLNETRNQY

SEQ ID NO: 3346 - protein, 31 aa, Artificial
  Consensus peptide
RCQLGDRLNVEVDTAPTVDLNQVLNETRNQY

SEQ ID NO: 3347 - protein, 31 aa, Artificial
  Consensus peptide
RSQLGDRLNVEVDTAPTVDLNQVLNETRNQY

SEQ ID NO: 3348 - protein, 31 aa, Artificial
  Consensus peptide
RCPLGDRLNVEVDTAPTVDLNQVLNETRNQY

SEQ ID NO: 3349 - protein, 31 aa, Artificial
  Consensus peptide
RSPLGDRLNVEVDTAPTVDLNQVLNETRNQY

SEQ ID NO: 3350 - protein, 31 aa, Artificial
  Consensus peptide
RCQLGDRLNVEVDAAPTVDLNRVLNETRNQY

SEQ ID NO: 3351 - protein, 31 aa, Artificial
  Consensus peptide
RSQLGDRLNVEVDAAPTVDLNRVLNETRNQY

SEQ ID NO: 3352 - protein, 31 aa, Artificial
  Consensus peptide
RCPLGDRLNVEVDAAPTVDLNRVLNETRNQY

SEQ ID NO: 3353 - protein, 31 aa, Artificial
  Consensus peptide
RSPLGDRLNVEVDAAPTVDLNRVLNETRNQY

SEQ ID NO: 3354 - protein, 31 aa, Artificial
  Consensus peptide
RCQLGDRLNVEVDTAPTVDLNRVLNETRNQY

SEQ ID NO: 3355 - protein, 31 aa, Artificial
  Consensus peptide
RSQLGDRLNVEVDTAPTVDLNRVLNETRNQY

SEQ ID NO: 3356 - protein, 31 aa, Artificial
  Consensus peptide
RCPLGDRLNVEVDTAPTVDLNRVLNETRNQY

SEQ ID NO: 3357 - protein, 31 aa, Artificial
  Consensus peptide
RSPLGDRLNVEVDTAPTVDLNRVLNETRNQY

SEQ ID NO: 3358 - protein, 31 aa, Artificial
  Consensus peptide
CQLGDRLNVEVDAAPTVDLNQVLNETRSQYE

SEQ ID NO: 3359 - protein, 31 aa, Artificial
  Consensus peptide
SQLGDRLNVEVDAAPTVDLNQVLNETRSQYE

SEQ ID NO: 3360 - protein, 31 aa, Artificial
  Consensus peptide
CPLGDRLNVEVDAAPTVDLNQVLNETRSQYE

SEQ ID NO: 3361 - protein, 31 aa, Artificial
  Consensus peptide
SPLGDRLNVEVDAAPTVDLNQVLNETRSQYE

SEQ ID NO: 3362 - protein, 31 aa, Artificial
  Consensus peptide
CQLGDRLNVEVDTAPTVDLNQVLNETRSQYE

SEQ ID NO: 3363 - protein, 31 aa, Artificial
  Consensus peptide
SQLGDRLNVEVDTAPTVDLNQVLNETRSQYE

SEQ ID NO: 3364 - protein, 31 aa, Artificial
  Consensus peptide
CPLGDRLNVEVDTAPTVDLNQVLNETRSQYE

SEQ ID NO: 3365 - protein, 31 aa, Artificial
  Consensus peptide
SPLGDRLNVEVDTAPTVDLNQVLNETRSQYE

SEQ ID NO: 3366 - protein, 31 aa, Artificial
  Consensus peptide
CQLGDRLNVEVDAAPTVDLNRVLNETRSQYE

SEQ ID NO: 3367 - protein, 31 aa, Artificial
  Consensus peptide
SQLGDRLNVEVDAAPTVDLNRVLNETRSQYE

SEQ ID NO: 3368 - protein, 31 aa, Artificial
  Consensus peptide
CPLGDRLNVEVDAAPTVDLNRVLNETRSQYE

SEQ ID NO: 3369 - protein, 31 aa, Artificial
  Consensus peptide
SPLGDRLNVEVDAAPTVDLNRVLNETRSQYE

SEQ ID NO: 3370 - protein, 31 aa, Artificial
  Consensus peptide
CQLGDRLNVEVDTAPTVDLNRVLNETRSQYE

SEQ ID NO: 3371 - protein, 31 aa, Artificial
  Consensus peptide
SQLGDRLNVEVDTAPTVDLNRVLNETRSQYE

SEQ ID NO: 3372 - protein, 31 aa, Artificial
  Consensus peptide
CPLGDRLNVEVDTAPTVDLNRVLNETRSQYE

SEQ ID NO: 3373 - protein, 31 aa, Artificial
  Consensus peptide
SPLGDRLNVEVDTAPTVDLNRVLNETRSQYE

SEQ ID NO: 3374 - protein, 31 aa, Artificial
  Consensus peptide
CQLGDRLNVEVDAAPTVDLNQVLNETRNQYE

SEQ ID NO: 3375 - protein, 31 aa, Artificial
  Consensus peptide
SQLGDRLNVEVDAAPTVDLNQVLNETRNQYE

SEQ ID NO: 3376 - protein, 31 aa, Artificial
  Consensus peptide
CPLGDRLNVEVDAAPTVDLNQVLNETRNQYE

SEQ ID NO: 3377 - protein, 31 aa, Artificial
  Consensus peptide
SPLGDRLNVEVDAAPTVDLNQVLNETRNQYE

SEQ ID NO: 3378 - protein, 31 aa, Artificial
  Consensus peptide
CQLGDRLNVEVDTAPTVDLNQVLNETRNQYE

SEQ ID NO: 3379 - protein, 31 aa, Artificial
  Consensus peptide
SQLGDRLNVEVDTAPTVDLNQVLNETRNQYE

SEQ ID NO: 3380 - protein, 31 aa, Artificial
  Consensus peptide
CPLGDRLNVEVDTAPTVDLNQVLNETRNQYE

SEQ ID NO: 3381 - protein, 31 aa, Artificial
  Consensus peptide
SPLGDRLNVEVDTAPTVDLNQVLNETRNQYE

SEQ ID NO: 3382 - protein, 31 aa, Artificial
  Consensus peptide
CQLGDRLNVEVDAAPTVDLNRVLNETRNQYE

SEQ ID NO: 3383 - protein, 31 aa, Artificial
  Consensus peptide
SQLGDRLNVEVDAAPTVDLNRVLNETRNQYE

SEQ ID NO: 3384 - protein, 31 aa, Artificial
  Consensus peptide
CPLGDRLNVEVDAAPTVDLNRVLNETRNQYE

SEQ ID NO: 3385 - protein, 31 aa, Artificial
  Consensus peptide
SPLGDRLNVEVDAAPTVDLNRVLNETRNQYE

SEQ ID NO: 3386 - protein, 31 aa, Artificial
  Consensus peptide
CQLGDRLNVEVDTAPTVDLNRVLNETRNQYE

SEQ ID NO: 3387 - protein, 31 aa, Artificial
  Consensus peptide
SQLGDRLNVEVDTAPTVDLNRVLNETRNQYE

SEQ ID NO: 3388 - protein, 31 aa, Artificial
  Consensus peptide
CPLGDRLNVEVDTAPTVDLNRVLNETRNQYE

SEQ ID NO: 3389 - protein, 31 aa, Artificial
  Consensus peptide
SPLGDRLNVEVDTAPTVDLNRVLNETRNQYE

SEQ ID NO: 3390 - protein, 31 aa, Artificial
  Consensus peptide
QLGDRLNVEVDAAPTVDLNQVLNETRSQYEA

SEQ ID NO: 3391 - protein, 31 aa, Artificial
  Consensus peptide
PLGDRLNVEVDAAPTVDLNQVLNETRSQYEA

SEQ ID NO: 3392 - protein, 31 aa, Artificial
  Consensus peptide
QLGDRLNVEVDTAPTVDLNQVLNETRSQYEA

SEQ ID NO: 3393 - protein, 31 aa, Artificial
  Consensus peptide
PLGDRLNVEVDTAPTVDLNQVLNETRSQYEA

SEQ ID NO: 3394 - protein, 31 aa, Artificial
  Consensus peptide
QLGDRLNVEVDAAPTVDLNRVLNETRSQYEA

SEQ ID NO: 3395 - protein, 31 aa, Artificial
  Consensus peptide
PLGDRLNVEVDAAPTVDLNRVLNETRSQYEA

SEQ ID NO: 3396 - protein, 31 aa, Artificial
  Consensus peptide
QLGDRLNVEVDTAPTVDLNRVLNETRSQYEA

SEQ ID NO: 3397 - protein, 31 aa, Artificial
  Consensus peptide
PLGDRLNVEVDTAPTVDLNRVLNETRSQYEA

SEQ ID NO: 3398 - protein, 31 aa, Artificial
  Consensus peptide
QLGDRLNVEVDAAPTVDLNQVLNETRNQYEA

SEQ ID NO: 3399 - protein, 31 aa, Artificial
  Consensus peptide
PLGDRLNVEVDAAPTVDLNQVLNETRNQYEA

SEQ ID NO: 3400 - protein, 31 aa, Artificial
  Consensus peptide
QLGDRLNVEVDTAPTVDLNQVLNETRNQYEA

SEQ ID NO: 3401 - protein, 31 aa, Artificial
  Consensus peptide
PLGDRLNVEVDTAPTVDLNQVLNETRNQYEA

SEQ ID NO: 3402 - protein, 31 aa, Artificial
  Consensus peptide
QLGDRLNVEVDAAPTVDLNRVLNETRNQYEA

SEQ ID NO: 3403 - protein, 31 aa, Artificial
  Consensus peptide
PLGDRLNVEVDAAPTVDLNRVLNETRNQYEA

SEQ ID NO: 3404 - protein, 31 aa, Artificial
  Consensus peptide
QLGDRLNVEVDTAPTVDLNRVLNETRNQYEA

SEQ ID NO: 3405 - protein, 31 aa, Artificial
  Consensus peptide
PLGDRLNVEVDTAPTVDLNRVLNETRNQYEA

SEQ ID NO: 3406 - protein, 31 aa, Artificial
  Consensus peptide
LGDRLNVEVDAAPTVDLNQVLNETRSQYEAL

SEQ ID NO: 3407 - protein, 31 aa, Artificial
  Consensus peptide
LGDRLNVEVDTAPTVDLNQVLNETRSQYEAL

SEQ ID NO: 3408 - protein, 31 aa, Artificial
  Consensus peptide
LGDRLNVEVDAAPTVDLNRVLNETRSQYEAL

SEQ ID NO: 3409 - protein, 31 aa, Artificial
  Consensus peptide
LGDRLNVEVDTAPTVDLNRVLNETRSQYEAL

SEQ ID NO: 3410 - protein, 31 aa, Artificial
  Consensus peptide
LGDRLNVEVDAAPTVDLNQVLNETRNQYEAL

SEQ ID NO: 3411 - protein, 31 aa, Artificial
  Consensus peptide
LGDRLNVEVDTAPTVDLNQVLNETRNQYEAL

SEQ ID NO: 3412 - protein, 32 aa, Artificial
  Consensus peptide
ELGDRLNVEVDAAPTVDLNRVLNETRNQYEAL

SEQ ID NO: 3413 - protein, 31 aa, Artificial
  Consensus peptide
LGDRLNVEVDTAPTVDLNRVLNETRNQYEAL

SEQ ID NO: 3414 - protein, 32 aa, Artificial
  Consensus peptide
EVNTLRCQLGDRLNVEVDAAPTVDLNQVLNET

SEQ ID NO: 3415 - protein, 32 aa, Artificial
  Consensus peptide
EVNTLRSQLGDRLNVEVDAAPTVDLNQVLNET

SEQ ID NO: 3416 - protein, 32 aa, Artificial
  Consensus peptide
EVNTLRCPLGDRLNVEVDAAPTVDLNQVLNET

SEQ ID NO: 3417 - protein, 32 aa, Artificial
  Consensus peptide
EVNTLRSPLGDRLNVEVDAAPTVDLNQVLNET

SEQ ID NO: 3418 - protein, 32 aa, Artificial
  Consensus peptide
EVNTLRCQLGDRLNVEVDTAPTVDLNQVLNET

SEQ ID NO: 3419 - protein, 32 aa, Artificial
  Consensus peptide
EVNTLRSQLGDRLNVEVDTAPTVDLNQVLNET

SEQ ID NO: 3420 - protein, 32 aa, Artificial
  Consensus peptide
EVNTLRCPLGDRLNVEVDTAPTVDLNQVLNET

SEQ ID NO: 3421 - protein, 32 aa, Artificial
  Consensus peptide
EVNTLRSPLGDRLNVEVDTAPTVDLNQVLNET

SEQ ID NO: 3422 - protein, 32 aa, Artificial
  Consensus peptide
EVNTLRCQLGDRLNVEVDAAPTVDLNRVLNET

SEQ ID NO: 3423 - protein, 32 aa, Artificial
  Consensus peptide
EVNTLRSQLGDRLNVEVDAAPTVDLNRVLNET

SEQ ID NO: 3424 - protein, 32 aa, Artificial
  Consensus peptide
EVNTLRCPLGDRLNVEVDAAPTVDLNRVLNET

SEQ ID NO: 3425 - protein, 32 aa, Artificial
  Consensus peptide
EVNTLRSPLGDRLNVEVDAAPTVDLNRVLNET

SEQ ID NO: 3426 - protein, 32 aa, Artificial
  Consensus peptide
EVNTLRCQLGDRLNVEVDTAPTVDLNRVLNET

SEQ ID NO: 3427 - protein, 32 aa, Artificial
  Consensus peptide
EVNTLRSQLGDRLNVEVDTAPTVDLNRVLNET

SEQ ID NO: 3428 - protein, 32 aa, Artificial
  Consensus peptide
EVNTLRCPLGDRLNVEVDTAPTVDLNRVLNET

SEQ ID NO: 3429 - protein, 32 aa, Artificial
  Consensus peptide
EVNTLRSPLGDRLNVEVDTAPTVDLNRVLNET

SEQ ID NO: 3430 - protein, 32 aa, Artificial
  Consensus peptide
VNTLRCQLGDRLNVEVDAAPTVDLNQVLNETR

SEQ ID NO: 3431 - protein, 32 aa, Artificial
  Consensus peptide
VNTLRSQLGDRLNVEVDAAPTVDLNQVLNETR

SEQ ID NO: 3432 - protein, 32 aa, Artificial
  Consensus peptide
VNTLRCPLGDRLNVEVDAAPTVDLNQVLNETR

SEQ ID NO: 3433 - protein, 32 aa, Artificial
  Consensus peptide
VNTLRSPLGDRLNVEVDAAPTVDLNQVLNETR

SEQ ID NO: 3434 - protein, 32 aa, Artificial
  Consensus peptide
VNTLRCQLGDRLNVEVDTAPTVDLNQVLNETR

SEQ ID NO: 3435 - protein, 32 aa, Artificial
  Consensus peptide
VNTLRSQLGDRLNVEVDTAPTVDLNQVLNETR

SEQ ID NO: 3436 - protein, 32 aa, Artificial
  Consensus peptide
VNTLRCPLGDRLNVEVDTAPTVDLNQVLNETR

SEQ ID NO: 3437 - protein, 32 aa, Artificial
  Consensus peptide
VNTLRSPLGDRLNVEVDTAPTVDLNQVLNETR

SEQ ID NO: 3438 - protein, 32 aa, Artificial
  Consensus peptide
VNTLRCQLGDRLNVEVDAAPTVDLNRVLNETR

SEQ ID NO: 3439 - protein, 32 aa, Artificial
  Consensus peptide
VNTLRSQLGDRLNVEVDAAPTVDLNRVLNETR

SEQ ID NO: 3440 - protein, 32 aa, Artificial
  Consensus peptide
VNTLRCPLGDRLNVEVDAAPTVDLNRVLNETR

SEQ ID NO: 3441 - protein, 32 aa, Artificial
  Consensus peptide
VNTLRSPLGDRLNVEVDAAPTVDLNRVLNETR

SEQ ID NO: 3442 - protein, 32 aa, Artificial
  Consensus peptide
VNTLRCQLGDRLNVEVDTAPTVDLNRVLNETR

SEQ ID NO: 3443 - protein, 32 aa, Artificial
  Consensus peptide
VNTLRSQLGDRLNVEVDTAPTVDLNRVLNETR

SEQ ID NO: 3444 - protein, 32 aa, Artificial
  Consensus peptide
VNTLRCPLGDRLNVEVDTAPTVDLNRVLNETR

SEQ ID NO: 3445 - protein, 32 aa, Artificial
  Consensus peptide
VNTLRSPLGDRLNVEVDTAPTVDLNRVLNETR

SEQ ID NO: 3446 - protein, 32 aa, Artificial
  Consensus peptide
NTLRCQLGDRLNVEVDAAPTVDLNQVLNETRS

SEQ ID NO: 3447 - protein, 32 aa, Artificial
  Consensus peptide
NTLRSQLGDRLNVEVDAAPTVDLNQVLNETRS

SEQ ID NO: 3448 - protein, 32 aa, Artificial
  Consensus peptide
NTLRCPLGDRLNVEVDAAPTVDLNQVLNETRS

SEQ ID NO: 3449 - protein, 32 aa, Artificial
  Consensus peptide
NTLRSPLGDRLNVEVDAAPTVDLNQVLNETRS

SEQ ID NO: 3450 - protein, 32 aa, Artificial
  Consensus peptide
NTLRCQLGDRLNVEVDTAPTVDLNQVLNETRS

SEQ ID NO: 3451 - protein, 32 aa, Artificial
  Consensus peptide
NTLRSQLGDRLNVEVDTAPTVDLNQVLNETRS

SEQ ID NO: 3452 - protein, 32 aa, Artificial
  Consensus peptide
NTLRCPLGDRLNVEVDTAPTVDLNQVLNETRS

SEQ ID NO: 3453 - protein, 32 aa, Artificial
  Consensus peptide
NTLRSPLGDRLNVEVDTAPTVDLNQVLNETRS

SEQ ID NO: 3454 - protein, 32 aa, Artificial
  Consensus peptide
NTLRCQLGDRLNVEVDAAPTVDLNRVLNETRS

SEQ ID NO: 3455 - protein, 32 aa, Artificial
  Consensus peptide
NTLRSQLGDRLNVEVDAAPTVDLNRVLNETRS

SEQ ID NO: 3456 - protein, 32 aa, Artificial
  Consensus peptide
NTLRCPLGDRLNVEVDAAPTVDLNRVLNETRS

SEQ ID NO: 3457 - protein, 32 aa, Artificial
  Consensus peptide
NTLRSPLGDRLNVEVDAAPTVDLNRVLNETRS

SEQ ID NO: 3458 - protein, 32 aa, Artificial
  Consensus peptide
NTLRCQLGDRLNVEVDTAPTVDLNRVLNETRS

SEQ ID NO: 3459 - protein, 32 aa, Artificial
  Consensus peptide
NTLRSQLGDRLNVEVDTAPTVDLNRVLNETRS

SEQ ID NO: 3460 - protein, 32 aa, Artificial
  Consensus peptide
NTLRCPLGDRLNVEVDTAPTVDLNRVLNETRS

SEQ ID NO: 3461 - protein, 32 aa, Artificial
  Consensus peptide
NTLRSPLGDRLNVEVDTAPTVDLNRVLNETRS

SEQ ID NO: 3462 - protein, 32 aa, Artificial
  Consensus peptide
NTLRCQLGDRLNVEVDAAPTVDLNQVLNETRN

SEQ ID NO: 3463 - protein, 32 aa, Artificial
  Consensus peptide
NTLRSQLGDRLNVEVDAAPTVDLNQVLNETRN

SEQ ID NO: 3464 - protein, 32 aa, Artificial
  Consensus peptide
NTLRCPLGDRLNVEVDAAPTVDLNQVLNETRN

SEQ ID NO: 3465 - protein, 32 aa, Artificial
  Consensus peptide
NTLRSPLGDRLNVEVDAAPTVDLNQVLNETRN

SEQ ID NO: 3466 - protein, 32 aa, Artificial
  Consensus peptide
NTLRCQLGDRLNVEVDTAPTVDLNQVLNETRN

SEQ ID NO: 3467 - protein, 32 aa, Artificial
  Consensus peptide
NTLRSQLGDRLNVEVDTAPTVDLNQVLNETRN

SEQ ID NO: 3468 - protein, 32 aa, Artificial
  Consensus peptide
NTLRCPLGDRLNVEVDTAPTVDLNQVLNETRN

SEQ ID NO: 3469 - protein, 32 aa, Artificial
  Consensus peptide
NTLRSPLGDRLNVEVDTAPTVDLNQVLNETRN

SEQ ID NO: 3470 - protein, 32 aa, Artificial
  Consensus peptide
NTLRCQLGDRLNVEVDAAPTVDLNRVLNETRN

SEQ ID NO: 3471 - protein, 32 aa, Artificial
  Consensus peptide
NTLRSQLGDRLNVEVDAAPTVDLNRVLNETRN

SEQ ID NO: 3472 - protein, 32 aa, Artificial
  Consensus peptide
NTLRCPLGDRLNVEVDAAPTVDLNRVLNETRN

SEQ ID NO: 3473 - protein, 32 aa, Artificial
  Consensus peptide
NTLRSPLGDRLNVEVDAAPTVDLNRVLNETRN

SEQ ID NO: 3474 - protein, 32 aa, Artificial
  Consensus peptide
NTLRCQLGDRLNVEVDTAPTVDLNRVLNETRN

SEQ ID NO: 3475 - protein, 32 aa, Artificial
  Consensus peptide
NTLRSQLGDRLNVEVDTAPTVDLNRVLNETRN

SEQ ID NO: 3476 - protein, 32 aa, Artificial
  Consensus peptide
NTLRCPLGDRLNVEVDTAPTVDLNRVLNETRN

SEQ ID NO: 3477 - protein, 32 aa, Artificial
  Consensus peptide
NTLRSPLGDRLNVEVDTAPTVDLNRVLNETRN

SEQ ID NO: 3478 - protein, 32 aa, Artificial
  Consensus peptide
TLRCQLGDRLNVEVDAAPTVDLNQVLNETRSQ

SEQ ID NO: 3479 - protein, 32 aa, Artificial
  Consensus peptide
TLRSQLGDRLNVEVDAAPTVDLNQVLNETRSQ

SEQ ID NO: 3480 - protein, 32 aa, Artificial
  Consensus peptide
TLRCPLGDRLNVEVDAAPTVDLNQVLNETRSQ

SEQ ID NO: 3481 - protein, 32 aa, Artificial
  Consensus peptide
TLRSPLGDRLNVEVDAAPTVDLNQVLNETRSQ

SEQ ID NO: 3482 - protein, 32 aa, Artificial
  Consensus peptide
TLRCQLGDRLNVEVDTAPTVDLNQVLNETRSQ

SEQ ID NO: 3483 - protein, 32 aa, Artificial
  Consensus peptide
TLRSQLGDRLNVEVDTAPTVDLNQVLNETRSQ

SEQ ID NO: 3484 - protein, 32 aa, Artificial
  Consensus peptide
TLRCPLGDRLNVEVDTAPTVDLNQVLNETRSQ

SEQ ID NO: 3485 - protein, 32 aa, Artificial
  Consensus peptide
TLRSPLGDRLNVEVDTAPTVDLNQVLNETRSQ

SEQ ID NO: 3486 - protein, 32 aa, Artificial
  Consensus peptide
TLRCQLGDRLNVEVDAAPTVDLNRVLNETRSQ

SEQ ID NO: 3487 - protein, 32 aa, Artificial
  Consensus peptide
TLRSQLGDRLNVEVDAAPTVDLNRVLNETRSQ

SEQ ID NO: 3488 - protein, 32 aa, Artificial
  Consensus peptide
TLRCPLGDRLNVEVDAAPTVDLNRVLNETRSQ

SEQ ID NO: 3489 - protein, 32 aa, Artificial
  Consensus peptide
TLRSPLGDRLNVEVDAAPTVDLNRVLNETRSQ

SEQ ID NO: 3490 - protein, 32 aa, Artificial
  Consensus peptide
TLRCQLGDRLNVEVDTAPTVDLNRVLNETRSQ

SEQ ID NO: 3491 - protein, 32 aa, Artificial
  Consensus peptide
TLRSQLGDRLNVEVDTAPTVDLNRVLNETRSQ

SEQ ID NO: 3492 - protein, 32 aa, Artificial
  Consensus peptide
TLRCPLGDRLNVEVDTAPTVDLNRVLNETRSQ

SEQ ID NO: 3493 - protein, 32 aa, Artificial
  Consensus peptide
TLRSPLGDRLNVEVDTAPTVDLNRVLNETRSQ

SEQ ID NO: 3494 - protein, 32 aa, Artificial
  Consensus peptide
TLRCQLGDRLNVEVDAAPTVDLNQVLNETRNQ

SEQ ID NO: 3495 - protein, 32 aa, Artificial
  Consensus peptide
TLRSQLGDRLNVEVDAAPTVDLNQVLNETRNQ

SEQ ID NO: 3496 - protein, 32 aa, Artificial
  Consensus peptide
TLRCPLGDRLNVEVDAAPTVDLNQVLNETRNQ

SEQ ID NO: 3497 - protein, 32 aa, Artificial
  Consensus peptide
TLRSPLGDRLNVEVDAAPTVDLNQVLNETRNQ

SEQ ID NO: 3498 - protein, 32 aa, Artificial
  Consensus peptide
TLRCQLGDRLNVEVDTAPTVDLNQVLNETRNQ

SEQ ID NO: 3499 - protein, 32 aa, Artificial
  Consensus peptide
TLRSQLGDRLNVEVDTAPTVDLNQVLNETRNQ

SEQ ID NO: 3500 - protein, 32 aa, Artificial
  Consensus peptide
TLRCPLGDRLNVEVDTAPTVDLNQVLNETRNQ

SEQ ID NO: 3501 - protein, 32 aa, Artificial
  Consensus peptide
TLRSPLGDRLNVEVDTAPTVDLNQVLNETRNQ

SEQ ID NO: 3502 - protein, 32 aa, Artificial
  Consensus peptide
TLRCQLGDRLNVEVDAAPTVDLNRVLNETRNQ

SEQ ID NO: 3503 - protein, 32 aa, Artificial
  Consensus peptide
TLRSQLGDRLNVEVDAAPTVDLNRVLNETRNQ

SEQ ID NO: 3504 - protein, 32 aa, Artificial
  Consensus peptide
TLRCPLGDRLNVEVDAAPTVDLNRVLNETRNQ

SEQ ID NO: 3505 - protein, 32 aa, Artificial
  Consensus peptide
TLRSPLGDRLNVEVDAAPTVDLNRVLNETRNQ

SEQ ID NO: 3506 - protein, 32 aa, Artificial
  Consensus peptide
TLRCQLGDRLNVEVDTAPTVDLNRVLNETRNQ

SEQ ID NO: 3507 - protein, 32 aa, Artificial
  Consensus peptide
TLRSQLGDRLNVEVDTAPTVDLNRVLNETRNQ

SEQ ID NO: 3508 - protein, 32 aa, Artificial
  Consensus peptide
TLRCPLGDRLNVEVDTAPTVDLNRVLNETRNQ

SEQ ID NO: 3509 - protein, 32 aa, Artificial
  Consensus peptide
TLRSPLGDRLNVEVDTAPTVDLNRVLNETRNQ

SEQ ID NO: 3510 - protein, 32 aa, Artificial
  Consensus peptide
LRCQLGDRLNVEVDAAPTVDLNQVLNETRSQY

SEQ ID NO: 3511 - protein, 32 aa, Artificial
  Consensus peptide
LRSQLGDRLNVEVDAAPTVDLNQVLNETRSQY

SEQ ID NO: 3512 - protein, 32 aa, Artificial
  Consensus peptide
LRCPLGDRLNVEVDAAPTVDLNQVLNETRSQY

SEQ ID NO: 3513 - protein, 32 aa, Artificial
  Consensus peptide
LRSPLGDRLNVEVDAAPTVDLNQVLNETRSQY

SEQ ID NO: 3514 - protein, 32 aa, Artificial
  Consensus peptide
LRCQLGDRLNVEVDTAPTVDLNQVLNETRSQY

SEQ ID NO: 3515 - protein, 32 aa, Artificial
  Consensus peptide
LRSQLGDRLNVEVDTAPTVDLNQVLNETRSQY

SEQ ID NO: 3516 - protein, 32 aa, Artificial
  Consensus peptide
LRCPLGDRLNVEVDTAPTVDLNQVLNETRSQY

SEQ ID NO: 3517 - protein, 32 aa, Artificial
  Consensus peptide
LRSPLGDRLNVEVDTAPTVDLNQVLNETRSQY

SEQ ID NO: 3518 - protein, 32 aa, Artificial
  Consensus peptide
LRCQLGDRLNVEVDAAPTVDLNRVLNETRSQY

SEQ ID NO: 3519 - protein, 32 aa, Artificial
  Consensus peptide
LRSQLGDRLNVEVDAAPTVDLNRVLNETRSQY

SEQ ID NO: 3520 - protein, 32 aa, Artificial
  Consensus peptide
LRCPLGDRLNVEVDAAPTVDLNRVLNETRSQY

SEQ ID NO: 3521 - protein, 32 aa, Artificial
  Consensus peptide
LRSPLGDRLNVEVDAAPTVDLNRVLNETRSQY

SEQ ID NO: 3522 - protein, 32 aa, Artificial
  Consensus peptide
LRCQLGDRLNVEVDTAPTVDLNRVLNETRSQY

SEQ ID NO: 3523 - protein, 32 aa, Artificial
  Consensus peptide
LRSQLGDRLNVEVDTAPTVDLNRVLNETRSQY

SEQ ID NO: 3524 - protein, 32 aa, Artificial
  Consensus peptide
LRCPLGDRLNVEVDTAPTVDLNRVLNETRSQY

SEQ ID NO: 3525 - protein, 32 aa, Artificial
  Consensus peptide
LRSPLGDRLNVEVDTAPTVDLNRVLNETRSQY

SEQ ID NO: 3526 - protein, 32 aa, Artificial
  Consensus peptide
LRCQLGDRLNVEVDAAPTVDLNQVLNETRNQY

SEQ ID NO: 3527 - protein, 32 aa, Artificial
  Consensus peptide
LRSQLGDRLNVEVDAAPTVDLNQVLNETRNQY

SEQ ID NO: 3528 - protein, 32 aa, Artificial
  Consensus peptide
LRCPLGDRLNVEVDAAPTVDLNQVLNETRNQY

SEQ ID NO: 3529 - protein, 32 aa, Artificial
  Consensus peptide
LRSPLGDRLNVEVDAAPTVDLNQVLNETRNQY

SEQ ID NO: 3530 - protein, 32 aa, Artificial
  Consensus peptide
LRCQLGDRLNVEVDTAPTVDLNQVLNETRNQY

SEQ ID NO: 3531 - protein, 32 aa, Artificial
  Consensus peptide
LRSQLGDRLNVEVDTAPTVDLNQVLNETRNQY

SEQ ID NO: 3532 - protein, 32 aa, Artificial
  Consensus peptide
LRCPLGDRLNVEVDTAPTVDLNQVLNETRNQY

SEQ ID NO: 3533 - protein, 32 aa, Artificial
  Consensus peptide
LRSPLGDRLNVEVDTAPTVDLNQVLNETRNQY

SEQ ID NO: 3534 - protein, 32 aa, Artificial
  Consensus peptide
LRCQLGDRLNVEVDAAPTVDLNRVLNETRNQY

SEQ ID NO: 3535 - protein, 32 aa, Artificial
  Consensus peptide
LRSQLGDRLNVEVDAAPTVDLNRVLNETRNQY

SEQ ID NO: 3536 - protein, 32 aa, Artificial
  Consensus peptide
LRCPLGDRLNVEVDAAPTVDLNRVLNETRNQY

SEQ ID NO: 3537 - protein, 32 aa, Artificial
  Consensus peptide
LRSPLGDRLNVEVDAAPTVDLNRVLNETRNQY

SEQ ID NO: 3538 - protein, 32 aa, Artificial
  Consensus peptide
LRCQLGDRLNVEVDTAPTVDLNRVLNETRNQY

SEQ ID NO: 3539 - protein, 32 aa, Artificial
  Consensus peptide
LRSQLGDRLNVEVDTAPTVDLNRVLNETRNQY

SEQ ID NO: 3540 - protein, 32 aa, Artificial
  Consensus peptide
LRCPLGDRLNVEVDTAPTVDLNRVLNETRNQY

SEQ ID NO: 3541 - protein, 32 aa, Artificial
  Consensus peptide
LRSPLGDRLNVEVDTAPTVDLNRVLNETRNQY

SEQ ID NO: 3542 - protein, 32 aa, Artificial
  Consensus peptide
RCQLGDRLNVEVDAAPTVDLNQVLNETRSQYE

SEQ ID NO: 3543 - protein, 32 aa, Artificial
  Consensus peptide
RSQLGDRLNVEVDAAPTVDLNQVLNETRSQYE

SEQ ID NO: 3544 - protein, 32 aa, Artificial
  Consensus peptide
RCPLGDRLNVEVDAAPTVDLNQVLNETRSQYE

SEQ ID NO: 3545 - protein, 32 aa, Artificial
  Consensus peptide
RSPLGDRLNVEVDAAPTVDLNQVLNETRSQYE

SEQ ID NO: 3546 - protein, 32 aa, Artificial
  Consensus peptide
RCQLGDRLNVEVDTAPTVDLNQVLNETRSQYE

SEQ ID NO: 3547 - protein, 32 aa, Artificial
  Consensus peptide
RSQLGDRLNVEVDTAPTVDLNQVLNETRSQYE

SEQ ID NO: 3548 - protein, 32 aa, Artificial
  Consensus peptide
RCPLGDRLNVEVDTAPTVDLNQVLNETRSQYE

SEQ ID NO: 3549 - protein, 32 aa, Artificial
  Consensus peptide
RSPLGDRLNVEVDTAPTVDLNQVLNETRSQYE

SEQ ID NO: 3550 - protein, 32 aa, Artificial
  Consensus peptide
RCQLGDRLNVEVDAAPTVDLNRVLNETRSQYE

SEQ ID NO: 3551 - protein, 32 aa, Artificial
  Consensus peptide
RSQLGDRLNVEVDAAPTVDLNRVLNETRSQYE

SEQ ID NO: 3552 - protein, 32 aa, Artificial
  Consensus peptide
RCPLGDRLNVEVDAAPTVDLNRVLNETRSQYE

SEQ ID NO: 3553 - protein, 32 aa, Artificial
  Consensus peptide
RSPLGDRLNVEVDAAPTVDLNRVLNETRSQYE

SEQ ID NO: 3554 - protein, 32 aa, Artificial
  Consensus peptide
RCQLGDRLNVEVDTAPTVDLNRVLNETRSQYE

SEQ ID NO: 3555 - protein, 32 aa, Artificial
  Consensus peptide
RSQLGDRLNVEVDTAPTVDLNRVLNETRSQYE

SEQ ID NO: 3556 - protein, 32 aa, Artificial
  Consensus peptide
RCPLGDRLNVEVDTAPTVDLNRVLNETRSQYE

SEQ ID NO: 3557 - protein, 32 aa, Artificial
  Consensus peptide
RSPLGDRLNVEVDTAPTVDLNRVLNETRSQYE

SEQ ID NO: 3558 - protein, 32 aa, Artificial
  Consensus peptide
RCQLGDRLNVEVDAAPTVDLNQVLNETRNQYE

SEQ ID NO: 3559 - protein, 32 aa, Artificial
  Consensus peptide
RSQLGDRLNVEVDAAPTVDLNQVLNETRNQYE

SEQ ID NO: 3560 - protein, 32 aa, Artificial
  Consensus peptide
RCPLGDRLNVEVDAAPTVDLNQVLNETRNQYE

SEQ ID NO: 3561 - protein, 32 aa, Artificial
  Consensus peptide
RSPLGDRLNVEVDAAPTVDLNQVLNETRNQYE

SEQ ID NO: 3562 - protein, 32 aa, Artificial
  Consensus peptide
RCQLGDRLNVEVDTAPTVDLNQVLNETRNQYE

SEQ ID NO: 3563 - protein, 32 aa, Artificial
  Consensus peptide
RSQLGDRLNVEVDTAPTVDLNQVLNETRNQYE

SEQ ID NO: 3564 - protein, 32 aa, Artificial
  Consensus peptide
RCPLGDRLNVEVDTAPTVDLNQVLNETRNQYE

SEQ ID NO: 3565 - protein, 32 aa, Artificial
  Consensus peptide
RSPLGDRLNVEVDTAPTVDLNQVLNETRNQYE

SEQ ID NO: 3566 - protein, 32 aa, Artificial
  Consensus peptide
RCQLGDRLNVEVDAAPTVDLNRVLNETRNQYE

SEQ ID NO: 3567 - protein, 32 aa, Artificial
  Consensus peptide
RSQLGDRLNVEVDAAPTVDLNRVLNETRNQYE

SEQ ID NO: 3568 - protein, 32 aa, Artificial
  Consensus peptide
RCPLGDRLNVEVDAAPTVDLNRVLNETRNQYE

SEQ ID NO: 3569 - protein, 32 aa, Artificial
  Consensus peptide
RSPLGDRLNVEVDAAPTVDLNRVLNETRNQYE

SEQ ID NO: 3570 - protein, 32 aa, Artificial
  Consensus peptide
RCQLGDRLNVEVDTAPTVDLNRVLNETRNQYE

SEQ ID NO: 3571 - protein, 32 aa, Artificial
  Consensus peptide
RSQLGDRLNVEVDTAPTVDLNRVLNETRNQYE

SEQ ID NO: 3572 - protein, 32 aa, Artificial
  Consensus peptide
RCPLGDRLNVEVDTAPTVDLNRVLNETRNQYE

SEQ ID NO: 3573 - protein, 32 aa, Artificial
  Consensus peptide
RSPLGDRLNVEVDTAPTVDLNRVLNETRNQYE

SEQ ID NO: 3574 - protein, 32 aa, Artificial
  Consensus peptide
CQLGDRLNVEVDAAPTVDLNQVLNETRSQYEA

SEQ ID NO: 3575 - protein, 32 aa, Artificial
  Consensus peptide
SQLGDRLNVEVDAAPTVDLNQVLNETRSQYEA

SEQ ID NO: 3576 - protein, 32 aa, Artificial
  Consensus peptide
CPLGDRLNVEVDAAPTVDLNQVLNETRSQYEA

SEQ ID NO: 3577 - protein, 32 aa, Artificial
  Consensus peptide
SPLGDRLNVEVDAAPTVDLNQVLNETRSQYEA

SEQ ID NO: 3578 - protein, 32 aa, Artificial
  Consensus peptide
CQLGDRLNVEVDTAPTVDLNQVLNETRSQYEA

SEQ ID NO: 3579 - protein, 32 aa, Artificial
  Consensus peptide
SQLGDRLNVEVDTAPTVDLNQVLNETRSQYEA

SEQ ID NO: 3580 - protein, 32 aa, Artificial
  Consensus peptide
CPLGDRLNVEVDTAPTVDLNQVLNETRSQYEA

SEQ ID NO: 3581 - protein, 32 aa, Artificial
  Consensus peptide
SPLGDRLNVEVDTAPTVDLNQVLNETRSQYEA

SEQ ID NO: 3582 - protein, 32 aa, Artificial
  Consensus peptide
CQLGDRLNVEVDAAPTVDLNRVLNETRSQYEA

SEQ ID NO: 3583 - protein, 32 aa, Artificial
  Consensus peptide
SQLGDRLNVEVDAAPTVDLNRVLNETRSQYEA

SEQ ID NO: 3584 - protein, 32 aa, Artificial
  Consensus peptide
CPLGDRLNVEVDAAPTVDLNRVLNETRSQYEA

SEQ ID NO: 3585 - protein, 32 aa, Artificial
  Consensus peptide
SPLGDRLNVEVDAAPTVDLNRVLNETRSQYEA

SEQ ID NO: 3586 - protein, 32 aa, Artificial
  Consensus peptide
CQLGDRLNVEVDTAPTVDLNRVLNETRSQYEA

SEQ ID NO: 3587 - protein, 32 aa, Artificial
  Consensus peptide
SQLGDRLNVEVDTAPTVDLNRVLNETRSQYEA

SEQ ID NO: 3588 - protein, 32 aa, Artificial
  Consensus peptide
CPLGDRLNVEVDTAPTVDLNRVLNETRSQYEA

SEQ ID NO: 3589 - protein, 32 aa, Artificial
  Consensus peptide
SPLGDRLNVEVDTAPTVDLNRVLNETRSQYEA

SEQ ID NO: 3590 - protein, 32 aa, Artificial
  Consensus peptide
CQLGDRLNVEVDAAPTVDLNQVLNETRNQYEA

SEQ ID NO: 3591 - protein, 32 aa, Artificial
  Consensus peptide
SQLGDRLNVEVDAAPTVDLNQVLNETRNQYEA

SEQ ID NO: 3592 - protein, 32 aa, Artificial
  Consensus peptide
CPLGDRLNVEVDAAPTVDLNQVLNETRNQYEA

SEQ ID NO: 3593 - protein, 32 aa, Artificial
  Consensus peptide
SPLGDRLNVEVDAAPTVDLNQVLNETRNQYEA

SEQ ID NO: 3594 - protein, 32 aa, Artificial
  Consensus peptide
CQLGDRLNVEVDTAPTVDLNQVLNETRNQYEA

SEQ ID NO: 3595 - protein, 32 aa, Artificial
  Consensus peptide
SQLGDRLNVEVDTAPTVDLNQVLNETRNQYEA

SEQ ID NO: 3596 - protein, 32 aa, Artificial
  Consensus peptide
CPLGDRLNVEVDTAPTVDLNQVLNETRNQYEA

SEQ ID NO: 3597 - protein, 32 aa, Artificial
  Consensus peptide
SPLGDRLNVEVDTAPTVDLNQVLNETRNQYEA

SEQ ID NO: 3598 - protein, 32 aa, Artificial
  Consensus peptide
CQLGDRLNVEVDAAPTVDLNRVLNETRNQYEA

SEQ ID NO: 3599 - protein, 32 aa, Artificial
  Consensus peptide
SQLGDRLNVEVDAAPTVDLNRVLNETRNQYEA

SEQ ID NO: 3600 - protein, 32 aa, Artificial
  Consensus peptide
CPLGDRLNVEVDAAPTVDLNRVLNETRNQYEA

SEQ ID NO: 3601 - protein, 32 aa, Artificial
  Consensus peptide
SPLGDRLNVEVDAAPTVDLNRVLNETRNQYEA

SEQ ID NO: 3602 - protein, 32 aa, Artificial
  Consensus peptide
CQLGDRLNVEVDTAPTVDLNRVLNETRNQYEA

SEQ ID NO: 3603 - protein, 32 aa, Artificial
  Consensus peptide
SQLGDRLNVEVDTAPTVDLNRVLNETRNQYEA

SEQ ID NO: 3604 - protein, 32 aa, Artificial
  Consensus peptide
CPLGDRLNVEVDTAPTVDLNRVLNETRNQYEA

SEQ ID NO: 3605 - protein, 32 aa, Artificial
  Consensus peptide
SPLGDRLNVEVDTAPTVDLNRVLNETRNQYEA

SEQ ID NO: 3606 - protein, 32 aa, Artificial
  Consensus peptide
QLGDRLNVEVDAAPTVDLNQVLNETRSQYEAL

SEQ ID NO: 3607 - protein, 32 aa, Artificial
  Consensus peptide
PLGDRLNVEVDAAPTVDLNQVLNETRSQYEAL

SEQ ID NO: 3608 - protein, 32 aa, Artificial
  Consensus peptide
QLGDRLNVEVDTAPTVDLNQVLNETRSQYEAL

SEQ ID NO: 3609 - protein, 32 aa, Artificial
  Consensus peptide
PLGDRLNVEVDTAPTVDLNQVLNETRSQYEAL

SEQ ID NO: 3610 - protein, 32 aa, Artificial
  Consensus peptide
QLGDRLNVEVDAAPTVDLNRVLNETRSQYEAL

SEQ ID NO: 3611 - protein, 32 aa, Artificial
  Consensus peptide
PLGDRLNVEVDAAPTVDLNRVLNETRSQYEAL

SEQ ID NO: 3612 - protein, 32 aa, Artificial
  Consensus peptide
QLGDRLNVEVDTAPTVDLNRVLNETRSQYEAL

SEQ ID NO: 3613 - protein, 32 aa, Artificial
  Consensus peptide
PLGDRLNVEVDTAPTVDLNRVLNETRSQYEAL

SEQ ID NO: 3614 - protein, 32 aa, Artificial
  Consensus peptide
QLGDRLNVEVDAAPTVDLNQVLNETRNQYEAL

SEQ ID NO: 3615 - protein, 32 aa, Artificial
  Consensus peptide
PLGDRLNVEVDAAPTVDLNQVLNETRNQYEAL

SEQ ID NO: 3616 - protein, 32 aa, Artificial
  Consensus peptide
QLGDRLNVEVDTAPTVDLNQVLNETRNQYEAL

SEQ ID NO: 3617 - protein, 32 aa, Artificial
  Consensus peptide
PLGDRLNVEVDTAPTVDLNQVLNETRNQYEAL

SEQ ID NO: 3618 - protein, 32 aa, Artificial
  Consensus peptide
QLGDRLNVEVDAAPTVDLNRVLNETRNQYEAL

SEQ ID NO: 3619 - protein, 32 aa, Artificial
  Consensus peptide
PLGDRLNVEVDAAPTVDLNRVLNETRNQYEAL

SEQ ID NO: 3620 - protein, 32 aa, Artificial
  Consensus peptide
QLGDRLNVEVDTAPTVDLNRVLNETRNQYEAL

SEQ ID NO: 3621 - protein, 32 aa, Artificial
  Consensus peptide
PLGDRLNVEVDTAPTVDLNRVLNETRNQYEAL

SEQ ID NO: 3622 - protein, 33 aa, Artificial
  Consensus peptide
EVNTLRCQLGDRLNVEVDAAPTVDLNQVLNETR

SEQ ID NO: 3623 - protein, 33 aa, Artificial
  Consensus peptide
EVNTLRSQLGDRLNVEVDAAPTVDLNQVLNETR

SEQ ID NO: 3624 - protein, 33 aa, Artificial
  Consensus peptide
EVNTLRCPLGDRLNVEVDAAPTVDLNQVLNETR

SEQ ID NO: 3625 - protein, 33 aa, Artificial
  Consensus peptide
EVNTLRSPLGDRLNVEVDAAPTVDLNQVLNETR

SEQ ID NO: 3626 - protein, 33 aa, Artificial
  Consensus peptide
EVNTLRCQLGDRLNVEVDTAPTVDLNQVLNETR

SEQ ID NO: 3627 - protein, 33 aa, Artificial
  Consensus peptide
EVNTLRSQLGDRLNVEVDTAPTVDLNQVLNETR

SEQ ID NO: 3628 - protein, 33 aa, Artificial
  Consensus peptide
EVNTLRCPLGDRLNVEVDTAPTVDLNQVLNETR

SEQ ID NO: 3629 - protein, 33 aa, Artificial
  Consensus peptide
EVNTLRSPLGDRLNVEVDTAPTVDLNQVLNETR

SEQ ID NO: 3630 - protein, 33 aa, Artificial
  Consensus peptide
EVNTLRCQLGDRLNVEVDAAPTVDLNRVLNETR

SEQ ID NO: 3631 - protein, 33 aa, Artificial
  Consensus peptide
EVNTLRSQLGDRLNVEVDAAPTVDLNRVLNETR

SEQ ID NO: 3632 - protein, 33 aa, Artificial
  Consensus peptide
EVNTLRCPLGDRLNVEVDAAPTVDLNRVLNETR

SEQ ID NO: 3633 - protein, 33 aa, Artificial
  Consensus peptide
EVNTLRSPLGDRLNVEVDAAPTVDLNRVLNETR

SEQ ID NO: 3634 - protein, 33 aa, Artificial
  Consensus peptide
EVNTLRCQLGDRLNVEVDTAPTVDLNRVLNETR

SEQ ID NO: 3635 - protein, 33 aa, Artificial
  Consensus peptide
EVNTLRSQLGDRLNVEVDTAPTVDLNRVLNETR

SEQ ID NO: 3636 - protein, 33 aa, Artificial
  Consensus peptide
EVNTLRCPLGDRLNVEVDTAPTVDLNRVLNETR

SEQ ID NO: 3637 - protein, 33 aa, Artificial
  Consensus peptide
EVNTLRSPLGDRLNVEVDTAPTVDLNRVLNETR

SEQ ID NO: 3638 - protein, 33 aa, Artificial
  Consensus peptide
VNTLRCQLGDRLNVEVDAAPTVDLNQVLNETRS

SEQ ID NO: 3639 - protein, 33 aa, Artificial
  Consensus peptide
VNTLRSQLGDRLNVEVDAAPTVDLNQVLNETRS

SEQ ID NO: 3640 - protein, 33 aa, Artificial
  Consensus peptide
VNTLRCPLGDRLNVEVDAAPTVDLNQVLNETRS

SEQ ID NO: 3641 - protein, 33 aa, Artificial
  Consensus peptide
VNTLRSPLGDRLNVEVDAAPTVDLNQVLNETRS

SEQ ID NO: 3642 - protein, 33 aa, Artificial
  Consensus peptide
VNTLRCQLGDRLNVEVDTAPTVDLNQVLNETRS

SEQ ID NO: 3643 - protein, 33 aa, Artificial
  Consensus peptide
VNTLRSQLGDRLNVEVDTAPTVDLNQVLNETRS

SEQ ID NO: 3644 - protein, 33 aa, Artificial
  Consensus peptide
VNTLRCPLGDRLNVEVDTAPTVDLNQVLNETRS

SEQ ID NO: 3645 - protein, 33 aa, Artificial
  Consensus peptide
VNTLRSPLGDRLNVEVDTAPTVDLNQVLNETRS

SEQ ID NO: 3646 - protein, 33 aa, Artificial
  Consensus peptide
VNTLRCQLGDRLNVEVDAAPTVDLNRVLNETRS

SEQ ID NO: 3647 - protein, 33 aa, Artificial
  Consensus peptide
VNTLRSQLGDRLNVEVDAAPTVDLNRVLNETRS

SEQ ID NO: 3648 - protein, 33 aa, Artificial
  Consensus peptide
VNTLRCPLGDRLNVEVDAAPTVDLNRVLNETRS

SEQ ID NO: 3649 - protein, 33 aa, Artificial
  Consensus peptide
VNTLRSPLGDRLNVEVDAAPTVDLNRVLNETRS

SEQ ID NO: 3650 - protein, 33 aa, Artificial
  Consensus peptide
VNTLRCQLGDRLNVEVDTAPTVDLNRVLNETRS

SEQ ID NO: 3651 - protein, 33 aa, Artificial
  Consensus peptide
VNTLRSQLGDRLNVEVDTAPTVDLNRVLNETRS

SEQ ID NO: 3652 - protein, 33 aa, Artificial
  Consensus peptide
VNTLRCPLGDRLNVEVDTAPTVDLNRVLNETRS

SEQ ID NO: 3653 - protein, 33 aa, Artificial
  Consensus peptide
VNTLRSPLGDRLNVEVDTAPTVDLNRVLNETRS

SEQ ID NO: 3654 - protein, 33 aa, Artificial
  Consensus peptide
VNTLRCQLGDRLNVEVDAAPTVDLNQVLNETRN

SEQ ID NO: 3655 - protein, 33 aa, Artificial
  Consensus peptide
VNTLRSQLGDRLNVEVDAAPTVDLNQVLNETRN

SEQ ID NO: 3656 - protein, 33 aa, Artificial
  Consensus peptide
VNTLRCPLGDRLNVEVDAAPTVDLNQVLNETRN

SEQ ID NO: 3657 - protein, 33 aa, Artificial
  Consensus peptide
VNTLRSPLGDRLNVEVDAAPTVDLNQVLNETRN

SEQ ID NO: 3658 - protein, 33 aa, Artificial
  Consensus peptide
VNTLRCQLGDRLNVEVDTAPTVDLNQVLNETRN

SEQ ID NO: 3659 - protein, 33 aa, Artificial
  Consensus peptide
VNTLRSQLGDRLNVEVDTAPTVDLNQVLNETRN

SEQ ID NO: 3660 - protein, 33 aa, Artificial
  Consensus peptide
VNTLRCPLGDRLNVEVDTAPTVDLNQVLNETRN

SEQ ID NO: 3661 - protein, 33 aa, Artificial
  Consensus peptide
VNTLRSPLGDRLNVEVDTAPTVDLNQVLNETRN

SEQ ID NO: 3662 - protein, 33 aa, Artificial
  Consensus peptide
VNTLRCQLGDRLNVEVDAAPTVDLNRVLNETRN

SEQ ID NO: 3663 - protein, 33 aa, Artificial
  Consensus peptide
VNTLRSQLGDRLNVEVDAAPTVDLNRVLNETRN

SEQ ID NO: 3664 - protein, 33 aa, Artificial
  Consensus peptide
VNTLRCPLGDRLNVEVDAAPTVDLNRVLNETRN

SEQ ID NO: 3665 - protein, 33 aa, Artificial
  Consensus peptide
VNTLRSPLGDRLNVEVDAAPTVDLNRVLNETRN

SEQ ID NO: 3666 - protein, 33 aa, Artificial
  Consensus peptide
VNTLRCQLGDRLNVEVDTAPTVDLNRVLNETRN

SEQ ID NO: 3667 - protein, 33 aa, Artificial
  Consensus peptide
VNTLRSQLGDRLNVEVDTAPTVDLNRVLNETRN

SEQ ID NO: 3668 - protein, 33 aa, Artificial
  Consensus peptide
VNTLRCPLGDRLNVEVDTAPTVDLNRVLNETRN

SEQ ID NO: 3669 - protein, 33 aa, Artificial
  Consensus peptide
VNTLRSPLGDRLNVEVDTAPTVDLNRVLNETRN

SEQ ID NO: 3670 - protein, 33 aa, Artificial
  Consensus peptide
NTLRCQLGDRLNVEVDAAPTVDLNQVLNETRSQ

SEQ ID NO: 3671 - protein, 33 aa, Artificial
  Consensus peptide
NTLRSQLGDRLNVEVDAAPTVDLNQVLNETRSQ

SEQ ID NO: 3672 - protein, 33 aa, Artificial
  Consensus peptide
NTLRCPLGDRLNVEVDAAPTVDLNQVLNETRSQ

SEQ ID NO: 3673 - protein, 33 aa, Artificial
  Consensus peptide
NTLRSPLGDRLNVEVDAAPTVDLNQVLNETRSQ

SEQ ID NO: 3674 - protein, 33 aa, Artificial
  Consensus peptide
NTLRCQLGDRLNVEVDTAPTVDLNQVLNETRSQ

SEQ ID NO: 3675 - protein, 33 aa, Artificial
  Consensus peptide
NTLRSQLGDRLNVEVDTAPTVDLNQVLNETRSQ

SEQ ID NO: 3676 - protein, 33 aa, Artificial
  Consensus peptide
NTLRCPLGDRLNVEVDTAPTVDLNQVLNETRSQ

SEQ ID NO: 3677 - protein, 33 aa, Artificial
  Consensus peptide
NTLRSPLGDRLNVEVDTAPTVDLNQVLNETRSQ

SEQ ID NO: 3678 - protein, 33 aa, Artificial
  Consensus peptide
NTLRCQLGDRLNVEVDAAPTVDLNRVLNETRSQ

SEQ ID NO: 3679 - protein, 33 aa, Artificial
  Consensus peptide
NTLRSQLGDRLNVEVDAAPTVDLNRVLNETRSQ

SEQ ID NO: 3680 - protein, 33 aa, Artificial
  Consensus peptide
NTLRCPLGDRLNVEVDAAPTVDLNRVLNETRSQ

SEQ ID NO: 3681 - protein, 33 aa, Artificial
  Consensus peptide
NTLRSPLGDRLNVEVDAAPTVDLNRVLNETRSQ

SEQ ID NO: 3682 - protein, 33 aa, Artificial
  Consensus peptide
NTLRCQLGDRLNVEVDTAPTVDLNRVLNETRSQ

SEQ ID NO: 3683 - protein, 33 aa, Artificial
  Consensus peptide
NTLRSQLGDRLNVEVDTAPTVDLNRVLNETRSQ

SEQ ID NO: 3684 - protein, 33 aa, Artificial
  Consensus peptide
NTLRCPLGDRLNVEVDTAPTVDLNRVLNETRSQ

SEQ ID NO: 3685 - protein, 33 aa, Artificial
  Consensus peptide
NTLRSPLGDRLNVEVDTAPTVDLNRVLNETRSQ

SEQ ID NO: 3686 - protein, 33 aa, Artificial
  Consensus peptide
NTLRCQLGDRLNVEVDAAPTVDLNQVLNETRNQ

SEQ ID NO: 3687 - protein, 33 aa, Artificial
  Consensus peptide
NTLRSQLGDRLNVEVDAAPTVDLNQVLNETRNQ

SEQ ID NO: 3688 - protein, 33 aa, Artificial
  Consensus peptide
NTLRCPLGDRLNVEVDAAPTVDLNQVLNETRNQ

SEQ ID NO: 3689 - protein, 33 aa, Artificial
  Consensus peptide
NTLRSPLGDRLNVEVDAAPTVDLNQVLNETRNQ

SEQ ID NO: 3690 - protein, 33 aa, Artificial
  Consensus peptide
NTLRCQLGDRLNVEVDTAPTVDLNQVLNETRNQ

SEQ ID NO: 3691 - protein, 33 aa, Artificial
  Consensus peptide
NTLRSQLGDRLNVEVDTAPTVDLNQVLNETRNQ

SEQ ID NO: 3692 - protein, 33 aa, Artificial
  Consensus peptide
NTLRCPLGDRLNVEVDTAPTVDLNQVLNETRNQ

SEQ ID NO: 3693 - protein, 33 aa, Artificial
  Consensus peptide
NTLRSPLGDRLNVEVDTAPTVDLNQVLNETRNQ

SEQ ID NO: 3694 - protein, 33 aa, Artificial
  Consensus peptide
NTLRCQLGDRLNVEVDAAPTVDLNRVLNETRNQ

SEQ ID NO: 3695 - protein, 33 aa, Artificial
  Consensus peptide
NTLRSQLGDRLNVEVDAAPTVDLNRVLNETRNQ

SEQ ID NO: 3696 - protein, 33 aa, Artificial
  Consensus peptide
NTLRCPLGDRLNVEVDAAPTVDLNRVLNETRNQ

SEQ ID NO: 3697 - protein, 33 aa, Artificial
  Consensus peptide
NTLRSPLGDRLNVEVDAAPTVDLNRVLNETRNQ

SEQ ID NO: 3698 - protein, 33 aa, Artificial
  Consensus peptide
NTLRCQLGDRLNVEVDTAPTVDLNRVLNETRNQ

SEQ ID NO: 3699 - protein, 33 aa, Artificial
  Consensus peptide
NTLRSQLGDRLNVEVDTAPTVDLNRVLNETRNQ

SEQ ID NO: 3700 - protein, 33 aa, Artificial
  Consensus peptide
NTLRCPLGDRLNVEVDTAPTVDLNRVLNETRNQ

SEQ ID NO: 3701 - protein, 33 aa, Artificial
  Consensus peptide
NTLRSPLGDRLNVEVDTAPTVDLNRVLNETRNQ

SEQ ID NO: 3702 - protein, 33 aa, Artificial
  Consensus peptide
TLRCQLGDRLNVEVDAAPTVDLNQVLNETRSQY

SEQ ID NO: 3703 - protein, 33 aa, Artificial
  Consensus peptide
TLRSQLGDRLNVEVDAAPTVDLNQVLNETRSQY

SEQ ID NO: 3704 - protein, 33 aa, Artificial
  Consensus peptide
TLRCPLGDRLNVEVDAAPTVDLNQVLNETRSQY

SEQ ID NO: 3705 - protein, 33 aa, Artificial
  Consensus peptide
TLRSPLGDRLNVEVDAAPTVDLNQVLNETRSQY

SEQ ID NO: 3706 - protein, 33 aa, Artificial
  Consensus peptide
TLRCQLGDRLNVEVDTAPTVDLNQVLNETRSQY

SEQ ID NO: 3707 - protein, 33 aa, Artificial
  Consensus peptide
TLRSQLGDRLNVEVDTAPTVDLNQVLNETRSQY

SEQ ID NO: 3708 - protein, 33 aa, Artificial
  Consensus peptide
TLRCPLGDRLNVEVDTAPTVDLNQVLNETRSQY

SEQ ID NO: 3709 - protein, 33 aa, Artificial
  Consensus peptide
TLRSPLGDRLNVEVDTAPTVDLNQVLNETRSQY

SEQ ID NO: 3710 - protein, 33 aa, Artificial
  Consensus peptide
TLRCQLGDRLNVEVDAAPTVDLNRVLNETRSQY

SEQ ID NO: 3711 - protein, 33 aa, Artificial
  Consensus peptide
TLRSQLGDRLNVEVDAAPTVDLNRVLNETRSQY

SEQ ID NO: 3712 - protein, 33 aa, Artificial
  Consensus peptide
TLRCPLGDRLNVEVDAAPTVDLNRVLNETRSQY

SEQ ID NO: 3713 - protein, 33 aa, Artificial
  Consensus peptide
TLRSPLGDRLNVEVDAAPTVDLNRVLNETRSQY

SEQ ID NO: 3714 - protein, 33 aa, Artificial
  Consensus peptide
TLRCQLGDRLNVEVDTAPTVDLNRVLNETRSQY

SEQ ID NO: 3715 - protein, 33 aa, Artificial
  Consensus peptide
TLRSQLGDRLNVEVDTAPTVDLNRVLNETRSQY

SEQ ID NO: 3716 - protein, 33 aa, Artificial
  Consensus peptide
TLRCPLGDRLNVEVDTAPTVDLNRVLNETRSQY

SEQ ID NO: 3717 - protein, 33 aa, Artificial
  Consensus peptide
TLRSPLGDRLNVEVDTAPTVDLNRVLNETRSQY

SEQ ID NO: 3718 - protein, 33 aa, Artificial
  Consensus peptide
TLRCQLGDRLNVEVDAAPTVDLNQVLNETRNQY

SEQ ID NO: 3719 - protein, 33 aa, Artificial
  Consensus peptide
TLRSQLGDRLNVEVDAAPTVDLNQVLNETRNQY

SEQ ID NO: 3720 - protein, 33 aa, Artificial
  Consensus peptide
TLRCPLGDRLNVEVDAAPTVDLNQVLNETRNQY

SEQ ID NO: 3721 - protein, 33 aa, Artificial
  Consensus peptide
TLRSPLGDRLNVEVDAAPTVDLNQVLNETRNQY

SEQ ID NO: 3722 - protein, 33 aa, Artificial
  Consensus peptide
TLRCQLGDRLNVEVDTAPTVDLNQVLNETRNQY

SEQ ID NO: 3723 - protein, 33 aa, Artificial
  Consensus peptide
TLRSQLGDRLNVEVDTAPTVDLNQVLNETRNQY

SEQ ID NO: 3724 - protein, 33 aa, Artificial
  Consensus peptide
TLRCPLGDRLNVEVDTAPTVDLNQVLNETRNQY

SEQ ID NO: 3725 - protein, 33 aa, Artificial
  Consensus peptide
TLRSPLGDRLNVEVDTAPTVDLNQVLNETRNQY

SEQ ID NO: 3726 - protein, 33 aa, Artificial
  Consensus peptide
TLRCQLGDRLNVEVDAAPTVDLNRVLNETRNQY

SEQ ID NO: 3727 - protein, 33 aa, Artificial
  Consensus peptide
TLRSQLGDRLNVEVDAAPTVDLNRVLNETRNQY

SEQ ID NO: 3728 - protein, 33 aa, Artificial
  Consensus peptide
TLRCPLGDRLNVEVDAAPTVDLNRVLNETRNQY

SEQ ID NO: 3729 - protein, 33 aa, Artificial
  Consensus peptide
TLRSPLGDRLNVEVDAAPTVDLNRVLNETRNQY

SEQ ID NO: 3730 - protein, 33 aa, Artificial
  Consensus peptide
TLRCQLGDRLNVEVDTAPTVDLNRVLNETRNQY

SEQ ID NO: 3731 - protein, 33 aa, Artificial
  Consensus peptide
TLRSQLGDRLNVEVDTAPTVDLNRVLNETRNQY

SEQ ID NO: 3732 - protein, 33 aa, Artificial
  Consensus peptide
TLRCPLGDRLNVEVDTAPTVDLNRVLNETRNQY

SEQ ID NO: 3733 - protein, 33 aa, Artificial
  Consensus peptide
TLRSPLGDRLNVEVDTAPTVDLNRVLNETRNQY

SEQ ID NO: 3734 - protein, 33 aa, Artificial
  Consensus peptide
LRCQLGDRLNVEVDAAPTVDLNQVLNETRSQYE

SEQ ID NO: 3735 - protein, 33 aa, Artificial
  Consensus peptide
LRSQLGDRLNVEVDAAPTVDLNQVLNETRSQYE

SEQ ID NO: 3736 - protein, 33 aa, Artificial
  Consensus peptide
LRCPLGDRLNVEVDAAPTVDLNQVLNETRSQYE

SEQ ID NO: 3737 - protein, 33 aa, Artificial
  Consensus peptide
LRSPLGDRLNVEVDAAPTVDLNQVLNETRSQYE

SEQ ID NO: 3738 - protein, 33 aa, Artificial
  Consensus peptide
LRCQLGDRLNVEVDTAPTVDLNQVLNETRSQYE

SEQ ID NO: 3739 - protein, 33 aa, Artificial
  Consensus peptide
LRSQLGDRLNVEVDTAPTVDLNQVLNETRSQYE

SEQ ID NO: 3740 - protein, 33 aa, Artificial
  Consensus peptide
LRCPLGDRLNVEVDTAPTVDLNQVLNETRSQYE

SEQ ID NO: 3741 - protein, 33 aa, Artificial
  Consensus peptide
LRSPLGDRLNVEVDTAPTVDLNQVLNETRSQYE

SEQ ID NO: 3742 - protein, 33 aa, Artificial
  Consensus peptide
LRCQLGDRLNVEVDAAPTVDLNRVLNETRSQYE

SEQ ID NO: 3743 - protein, 33 aa, Artificial
  Consensus peptide
LRSQLGDRLNVEVDAAPTVDLNRVLNETRSQYE

SEQ ID NO: 3744 - protein, 33 aa, Artificial
  Consensus peptide
LRCPLGDRLNVEVDAAPTVDLNRVLNETRSQYE

SEQ ID NO: 3745 - protein, 33 aa, Artificial
  Consensus peptide
LRSPLGDRLNVEVDAAPTVDLNRVLNETRSQYE

SEQ ID NO: 3746 - protein, 33 aa, Artificial
  Consensus peptide
LRCQLGDRLNVEVDTAPTVDLNRVLNETRSQYE

SEQ ID NO: 3747 - protein, 33 aa, Artificial
  Consensus peptide
LRSQLGDRLNVEVDTAPTVDLNRVLNETRSQYE

SEQ ID NO: 3748 - protein, 33 aa, Artificial
  Consensus peptide
LRCPLGDRLNVEVDTAPTVDLNRVLNETRSQYE

SEQ ID NO: 3749 - protein, 33 aa, Artificial
  Consensus peptide
LRSPLGDRLNVEVDTAPTVDLNRVLNETRSQYE

SEQ ID NO: 3750 - protein, 33 aa, Artificial
  Consensus peptide
LRCQLGDRLNVEVDAAPTVDLNQVLNETRNQYE

SEQ ID NO: 3751 - protein, 33 aa, Artificial
  Consensus peptide
LRSQLGDRLNVEVDAAPTVDLNQVLNETRNQYE

SEQ ID NO: 3752 - protein, 33 aa, Artificial
  Consensus peptide
LRCPLGDRLNVEVDAAPTVDLNQVLNETRNQYE

SEQ ID NO: 3753 - protein, 33 aa, Artificial
  Consensus peptide
LRSPLGDRLNVEVDAAPTVDLNQVLNETRNQYE

SEQ ID NO: 3754 - protein, 33 aa, Artificial
  Consensus peptide
LRCQLGDRLNVEVDTAPTVDLNQVLNETRNQYE

SEQ ID NO: 3755 - protein, 33 aa, Artificial
  Consensus peptide
LRSQLGDRLNVEVDTAPTVDLNQVLNETRNQYE

SEQ ID NO: 3756 - protein, 33 aa, Artificial
  Consensus peptide
LRCPLGDRLNVEVDTAPTVDLNQVLNETRNQYE

SEQ ID NO: 3757 - protein, 33 aa, Artificial
  Consensus peptide
LRSPLGDRLNVEVDTAPTVDLNQVLNETRNQYE

SEQ ID NO: 3758 - protein, 33 aa, Artificial
  Consensus peptide
LRCQLGDRLNVEVDAAPTVDLNRVLNETRNQYE

SEQ ID NO: 3759 - protein, 33 aa, Artificial
  Consensus peptide
LRSQLGDRLNVEVDAAPTVDLNRVLNETRNQYE

SEQ ID NO: 3760 - protein, 33 aa, Artificial
  Consensus peptide
LRCPLGDRLNVEVDAAPTVDLNRVLNETRNQYE

SEQ ID NO: 3761 - protein, 33 aa, Artificial
  Consensus peptide
LRSPLGDRLNVEVDAAPTVDLNRVLNETRNQYE

SEQ ID NO: 3762 - protein, 33 aa, Artificial
  Consensus peptide
LRCQLGDRLNVEVDTAPTVDLNRVLNETRNQYE

SEQ ID NO: 3763 - protein, 33 aa, Artificial
  Consensus peptide
LRSQLGDRLNVEVDTAPTVDLNRVLNETRNQYE

SEQ ID NO: 3764 - protein, 33 aa, Artificial
  Consensus peptide
LRCPLGDRLNVEVDTAPTVDLNRVLNETRNQYE

SEQ ID NO: 3765 - protein, 33 aa, Artificial
  Consensus peptide
LRSPLGDRLNVEVDTAPTVDLNRVLNETRNQYE

SEQ ID NO: 3766 - protein, 33 aa, Artificial
  Consensus peptide
RCQLGDRLNVEVDAAPTVDLNQVLNETRSQYEA

SEQ ID NO: 3767 - protein, 33 aa, Artificial
  Consensus peptide
RSQLGDRLNVEVDAAPTVDLNQVLNETRSQYEA

SEQ ID NO: 3768 - protein, 33 aa, Artificial
  Consensus peptide
RCPLGDRLNVEVDAAPTVDLNQVLNETRSQYEA

SEQ ID NO: 3769 - protein, 33 aa, Artificial
  Consensus peptide
RSPLGDRLNVEVDAAPTVDLNQVLNETRSQYEA

SEQ ID NO: 3770 - protein, 33 aa, Artificial
  Consensus peptide
RCQLGDRLNVEVDTAPTVDLNQVLNETRSQYEA

SEQ ID NO: 3771 - protein, 33 aa, Artificial
  Consensus peptide
RSQLGDRLNVEVDTAPTVDLNQVLNETRSQYEA

SEQ ID NO: 3772 - protein, 33 aa, Artificial
  Consensus peptide
RCPLGDRLNVEVDTAPTVDLNQVLNETRSQYEA

SEQ ID NO: 3773 - protein, 33 aa, Artificial
  Consensus peptide
RSPLGDRLNVEVDTAPTVDLNQVLNETRSQYEA

SEQ ID NO: 3774 - protein, 33 aa, Artificial
  Consensus peptide
RCQLGDRLNVEVDAAPTVDLNRVLNETRSQYEA

SEQ ID NO: 3775 - protein, 33 aa, Artificial
  Consensus peptide
RSQLGDRLNVEVDAAPTVDLNRVLNETRSQYEA

SEQ ID NO: 3776 - protein, 33 aa, Artificial
  Consensus peptide
RCPLGDRLNVEVDAAPTVDLNRVLNETRSQYEA

SEQ ID NO: 3777 - protein, 33 aa, Artificial
  Consensus peptide
RSPLGDRLNVEVDAAPTVDLNRVLNETRSQYEA

SEQ ID NO: 3778 - protein, 33 aa, Artificial
  Consensus peptide
RCQLGDRLNVEVDTAPTVDLNRVLNETRSQYEA

SEQ ID NO: 3779 - protein, 33 aa, Artificial
  Consensus peptide
RSQLGDRLNVEVDTAPTVDLNRVLNETRSQYEA

SEQ ID NO: 3780 - protein, 33 aa, Artificial
  Consensus peptide
RCPLGDRLNVEVDTAPTVDLNRVLNETRSQYEA

SEQ ID NO: 3781 - protein, 33 aa, Artificial
  Consensus peptide
RSPLGDRLNVEVDTAPTVDLNRVLNETRSQYEA

SEQ ID NO: 3782 - protein, 33 aa, Artificial
  Consensus peptide
RCQLGDRLNVEVDAAPTVDLNQVLNETRNQYEA

SEQ ID NO: 3783 - protein, 33 aa, Artificial
  Consensus peptide
RSQLGDRLNVEVDAAPTVDLNQVLNETRNQYEA

SEQ ID NO: 3784 - protein, 33 aa, Artificial
  Consensus peptide
RCPLGDRLNVEVDAAPTVDLNQVLNETRNQYEA

SEQ ID NO: 3785 - protein, 33 aa, Artificial
  Consensus peptide
RSPLGDRLNVEVDAAPTVDLNQVLNETRNQYEA

SEQ ID NO: 3786 - protein, 33 aa, Artificial
  Consensus peptide
RCQLGDRLNVEVDTAPTVDLNQVLNETRNQYEA

SEQ ID NO: 3787 - protein, 33 aa, Artificial
  Consensus peptide
RSQLGDRLNVEVDTAPTVDLNQVLNETRNQYEA

SEQ ID NO: 3788 - protein, 33 aa, Artificial
  Consensus peptide
RCPLGDRLNVEVDTAPTVDLNQVLNETRNQYEA

SEQ ID NO: 3789 - protein, 33 aa, Artificial
  Consensus peptide
RSPLGDRLNVEVDTAPTVDLNQVLNETRNQYEA

SEQ ID NO: 3790 - protein, 33 aa, Artificial
  Consensus peptide
RCQLGDRLNVEVDAAPTVDLNRVLNETRNQYEA

SEQ ID NO: 3791 - protein, 33 aa, Artificial
  Consensus peptide
RSQLGDRLNVEVDAAPTVDLNRVLNETRNQYEA

SEQ ID NO: 3792 - protein, 33 aa, Artificial
  Consensus peptide
RCPLGDRLNVEVDAAPTVDLNRVLNETRNQYEA

SEQ ID NO: 3793 - protein, 33 aa, Artificial
  Consensus peptide
RSPLGDRLNVEVDAAPTVDLNRVLNETRNQYEA

SEQ ID NO: 3794 - protein, 33 aa, Artificial
  Consensus peptide
RCQLGDRLNVEVDTAPTVDLNRVLNETRNQYEA

SEQ ID NO: 3795 - protein, 33 aa, Artificial
  Consensus peptide
RSQLGDRLNVEVDTAPTVDLNRVLNETRNQYEA

SEQ ID NO: 3796 - protein, 33 aa, Artificial
  Consensus peptide
RCPLGDRLNVEVDTAPTVDLNRVLNETRNQYEA

SEQ ID NO: 3797 - protein, 33 aa, Artificial
  Consensus peptide
RSPLGDRLNVEVDTAPTVDLNRVLNETRNQYEA

SEQ ID NO: 3798 - protein, 33 aa, Artificial
  Consensus peptide
CQLGDRLNVEVDAAPTVDLNQVLNETRSQYEAL

SEQ ID NO: 3799 - protein, 33 aa, Artificial
  Consensus peptide
SQLGDRLNVEVDAAPTVDLNQVLNETRSQYEAL

SEQ ID NO: 3800 - protein, 33 aa, Artificial
  Consensus peptide
CPLGDRLNVEVDAAPTVDLNQVLNETRSQYEAL

SEQ ID NO: 3801 - protein, 33 aa, Artificial
  Consensus peptide
SPLGDRLNVEVDAAPTVDLNQVLNETRSQYEAL

SEQ ID NO: 3802 - protein, 33 aa, Artificial
  Consensus peptide
CQLGDRLNVEVDTAPTVDLNQVLNETRSQYEAL

SEQ ID NO: 3803 - protein, 33 aa, Artificial
  Consensus peptide
SQLGDRLNVEVDTAPTVDLNQVLNETRSQYEAL

SEQ ID NO: 3804 - protein, 33 aa, Artificial
  Consensus peptide
CPLGDRLNVEVDTAPTVDLNQVLNETRSQYEAL

SEQ ID NO: 3805 - protein, 33 aa, Artificial
  Consensus peptide
SPLGDRLNVEVDTAPTVDLNQVLNETRSQYEAL

SEQ ID NO: 3806 - protein, 33 aa, Artificial
  Consensus peptide
CQLGDRLNVEVDAAPTVDLNRVLNETRSQYEAL

SEQ ID NO: 3807 - protein, 33 aa, Artificial
  Consensus peptide
SQLGDRLNVEVDAAPTVDLNRVLNETRSQYEAL

SEQ ID NO: 3808 - protein, 33 aa, Artificial
  Consensus peptide
CPLGDRLNVEVDAAPTVDLNRVLNETRSQYEAL

SEQ ID NO: 3809 - protein, 33 aa, Artificial
  Consensus peptide
SPLGDRLNVEVDAAPTVDLNRVLNETRSQYEAL

SEQ ID NO: 3810 - protein, 33 aa, Artificial
  Consensus peptide
CQLGDRLNVEVDTAPTVDLNRVLNETRSQYEAL

SEQ ID NO: 3811 - protein, 33 aa, Artificial
  Consensus peptide
SQLGDRLNVEVDTAPTVDLNRVLNETRSQYEAL

SEQ ID NO: 3812 - protein, 33 aa, Artificial
  Consensus peptide
CPLGDRLNVEVDTAPTVDLNRVLNETRSQYEAL

SEQ ID NO: 3813 - protein, 33 aa, Artificial
  Consensus peptide
SPLGDRLNVEVDTAPTVDLNRVLNETRSQYEAL

SEQ ID NO: 3814 - protein, 33 aa, Artificial
  Consensus peptide
CQLGDRLNVEVDAAPTVDLNQVLNETRNQYEAL

SEQ ID NO: 3815 - protein, 33 aa, Artificial
  Consensus peptide
SQLGDRLNVEVDAAPTVDLNQVLNETRNQYEAL

SEQ ID NO: 3816 - protein, 33 aa, Artificial
  Consensus peptide
CPLGDRLNVEVDAAPTVDLNQVLNETRNQYEAL

SEQ ID NO: 3817 - protein, 33 aa, Artificial
  Consensus peptide
SPLGDRLNVEVDAAPTVDLNQVLNETRNQYEAL

SEQ ID NO: 3818 - protein, 33 aa, Artificial
  Consensus peptide
CQLGDRLNVEVDTAPTVDLNQVLNETRNQYEAL

SEQ ID NO: 3819 - protein, 33 aa, Artificial
  Consensus peptide
SQLGDRLNVEVDTAPTVDLNQVLNETRNQYEAL

SEQ ID NO: 3820 - protein, 33 aa, Artificial
  Consensus peptide
CPLGDRLNVEVDTAPTVDLNQVLNETRNQYEAL

SEQ ID NO: 3821 - protein, 33 aa, Artificial
  Consensus peptide
SPLGDRLNVEVDTAPTVDLNQVLNETRNQYEAL

SEQ ID NO: 3822 - protein, 33 aa, Artificial
  Consensus peptide
CQLGDRLNVEVDAAPTVDLNRVLNETRNQYEAL

SEQ ID NO: 3823 - protein, 33 aa, Artificial
  Consensus peptide
SQLGDRLNVEVDAAPTVDLNRVLNETRNQYEAL

SEQ ID NO: 3824 - protein, 33 aa, Artificial
  Consensus peptide
CPLGDRLNVEVDAAPTVDLNRVLNETRNQYEAL

SEQ ID NO: 3825 - protein, 33 aa, Artificial
  Consensus peptide
SPLGDRLNVEVDAAPTVDLNRVLNETRNQYEAL

SEQ ID NO: 3826 - protein, 33 aa, Artificial
  Consensus peptide
CQLGDRLNVEVDTAPTVDLNRVLNETRNQYEAL

SEQ ID NO: 3827 - protein, 33 aa, Artificial
  Consensus peptide
SQLGDRLNVEVDTAPTVDLNRVLNETRNQYEAL

SEQ ID NO: 3828 - protein, 33 aa, Artificial
  Consensus peptide
CPLGDRLNVEVDTAPTVDLNRVLNETRNQYEAL

SEQ ID NO: 3829 - protein, 33 aa, Artificial
  Consensus peptide
SPLGDRLNVEVDTAPTVDLNRVLNETRNQYEAL

SEQ ID NO: 3830 - protein, 34 aa, Artificial
  Consensus peptide
EVNTLRCQLGDRLNVEVDAAPTVDLNQVLNETRS

SEQ ID NO: 3831 - protein, 34 aa, Artificial
  Consensus peptide
EVNTLRSQLGDRLNVEVDAAPTVDLNQVLNETRS

SEQ ID NO: 3832 - protein, 34 aa, Artificial
  Consensus peptide
EVNTLRCPLGDRLNVEVDAAPTVDLNQVLNETRS

SEQ ID NO: 3833 - protein, 34 aa, Artificial
  Consensus peptide
EVNTLRSPLGDRLNVEVDAAPTVDLNQVLNETRS

SEQ ID NO: 3834 - protein, 34 aa, Artificial
  Consensus peptide
EVNTLRCQLGDRLNVEVDTAPTVDLNQVLNETRS

SEQ ID NO: 3835 - protein, 34 aa, Artificial
  Consensus peptide
EVNTLRSQLGDRLNVEVDTAPTVDLNQVLNETRS

SEQ ID NO: 3836 - protein, 34 aa, Artificial
  Consensus peptide
EVNTLRCPLGDRLNVEVDTAPTVDLNQVLNETRS

SEQ ID NO: 3837 - protein, 34 aa, Artificial
  Consensus peptide
EVNTLRSPLGDRLNVEVDTAPTVDLNQVLNETRS

SEQ ID NO: 3838 - protein, 34 aa, Artificial
  Consensus peptide
EVNTLRCQLGDRLNVEVDAAPTVDLNRVLNETRS

SEQ ID NO: 3839 - protein, 34 aa, Artificial
  Consensus peptide
EVNTLRSQLGDRLNVEVDAAPTVDLNRVLNETRS

SEQ ID NO: 3840 - protein, 34 aa, Artificial
  Consensus peptide
EVNTLRCPLGDRLNVEVDAAPTVDLNRVLNETRS

SEQ ID NO: 3841 - protein, 34 aa, Artificial
  Consensus peptide
EVNTLRSPLGDRLNVEVDAAPTVDLNRVLNETRS

SEQ ID NO: 3842 - protein, 34 aa, Artificial
  Consensus peptide
EVNTLRCQLGDRLNVEVDTAPTVDLNRVLNETRS

SEQ ID NO: 3843 - protein, 34 aa, Artificial
  Consensus peptide
EVNTLRSQLGDRLNVEVDTAPTVDLNRVLNETRS

SEQ ID NO: 3844 - protein, 34 aa, Artificial
  Consensus peptide
EVNTLRCPLGDRLNVEVDTAPTVDLNRVLNETRS

SEQ ID NO: 3845 - protein, 34 aa, Artificial
  Consensus peptide
EVNTLRSPLGDRLNVEVDTAPTVDLNRVLNETRS

SEQ ID NO: 3846 - protein, 34 aa, Artificial
  Consensus peptide
EVNTLRCQLGDRLNVEVDAAPTVDLNQVLNETRN

SEQ ID NO: 3847 - protein, 34 aa, Artificial
  Consensus peptide
EVNTLRSQLGDRLNVEVDAAPTVDLNQVLNETRN

SEQ ID NO: 3848 - protein, 34 aa, Artificial
  Consensus peptide
EVNTLRCPLGDRLNVEVDAAPTVDLNQVLNETRN

SEQ ID NO: 3849 - protein, 34 aa, Artificial
  Consensus peptide
EVNTLRSPLGDRLNVEVDAAPTVDLNQVLNETRN

SEQ ID NO: 3850 - protein, 34 aa, Artificial
  Consensus peptide
EVNTLRCQLGDRLNVEVDTAPTVDLNQVLNETRN

SEQ ID NO: 3851 - protein, 34 aa, Artificial
  Consensus peptide
EVNTLRSQLGDRLNVEVDTAPTVDLNQVLNETRN

SEQ ID NO: 3852 - protein, 34 aa, Artificial
  Consensus peptide
EVNTLRCPLGDRLNVEVDTAPTVDLNQVLNETRN

SEQ ID NO: 3853 - protein, 34 aa, Artificial
  Consensus peptide
EVNTLRSPLGDRLNVEVDTAPTVDLNQVLNETRN

SEQ ID NO: 3854 - protein, 34 aa, Artificial
  Consensus peptide
EVNTLRCQLGDRLNVEVDAAPTVDLNRVLNETRN

SEQ ID NO: 3855 - protein, 34 aa, Artificial
  Consensus peptide
EVNTLRSQLGDRLNVEVDAAPTVDLNRVLNETRN

SEQ ID NO: 3856 - protein, 34 aa, Artificial
  Consensus peptide
EVNTLRCPLGDRLNVEVDAAPTVDLNRVLNETRN

SEQ ID NO: 3857 - protein, 34 aa, Artificial
  Consensus peptide
EVNTLRSPLGDRLNVEVDAAPTVDLNRVLNETRN

SEQ ID NO: 3858 - protein, 34 aa, Artificial
  Consensus peptide
EVNTLRCQLGDRLNVEVDTAPTVDLNRVLNETRN

SEQ ID NO: 3859 - protein, 34 aa, Artificial
  Consensus peptide
EVNTLRSQLGDRLNVEVDTAPTVDLNRVLNETRN

SEQ ID NO: 3860 - protein, 34 aa, Artificial
  Consensus peptide
EVNTLRCPLGDRLNVEVDTAPTVDLNRVLNETRN

SEQ ID NO: 3861 - protein, 34 aa, Artificial
  Consensus peptide
EVNTLRSPLGDRLNVEVDTAPTVDLNRVLNETRN

SEQ ID NO: 3862 - protein, 34 aa, Artificial
  Consensus peptide
VNTLRCQLGDRLNVEVDAAPTVDLNQVLNETRSQ

SEQ ID NO: 3863 - protein, 34 aa, Artificial
  Consensus peptide
VNTLRSQLGDRLNVEVDAAPTVDLNQVLNETRSQ

SEQ ID NO: 3864 - protein, 34 aa, Artificial
  Consensus peptide
VNTLRCPLGDRLNVEVDAAPTVDLNQVLNETRSQ

SEQ ID NO: 3865 - protein, 34 aa, Artificial
  Consensus peptide
VNTLRSPLGDRLNVEVDAAPTVDLNQVLNETRSQ

SEQ ID NO: 3866 - protein, 34 aa, Artificial
  Consensus peptide
VNTLRCQLGDRLNVEVDTAPTVDLNQVLNETRSQ

SEQ ID NO: 3867 - protein, 34 aa, Artificial
  Consensus peptide
VNTLRSQLGDRLNVEVDTAPTVDLNQVLNETRSQ

SEQ ID NO: 3868 - protein, 34 aa, Artificial
  Consensus peptide
VNTLRCPLGDRLNVEVDTAPTVDLNQVLNETRSQ

SEQ ID NO: 3869 - protein, 34 aa, Artificial
  Consensus peptide
VNTLRSPLGDRLNVEVDTAPTVDLNQVLNETRSQ

SEQ ID NO: 3870 - protein, 34 aa, Artificial
  Consensus peptide
VNTLRCQLGDRLNVEVDAAPTVDLNRVLNETRSQ

SEQ ID NO: 3871 - protein, 34 aa, Artificial
  Consensus peptide
VNTLRSQLGDRLNVEVDAAPTVDLNRVLNETRSQ

SEQ ID NO: 3872 - protein, 34 aa, Artificial
  Consensus peptide
VNTLRCPLGDRLNVEVDAAPTVDLNRVLNETRSQ

SEQ ID NO: 3873 - protein, 34 aa, Artificial
  Consensus peptide
VNTLRSPLGDRLNVEVDAAPTVDLNRVLNETRSQ

SEQ ID NO: 3874 - protein, 34 aa, Artificial
  Consensus peptide
VNTLRCQLGDRLNVEVDTAPTVDLNRVLNETRSQ

SEQ ID NO: 3875 - protein, 34 aa, Artificial
  Consensus peptide
VNTLRSQLGDRLNVEVDTAPTVDLNRVLNETRSQ

SEQ ID NO: 3876 - protein, 34 aa, Artificial
  Consensus peptide
VNTLRCPLGDRLNVEVDTAPTVDLNRVLNETRSQ

SEQ ID NO: 3877 - protein, 34 aa, Artificial
  Consensus peptide
VNTLRSPLGDRLNVEVDTAPTVDLNRVLNETRSQ

SEQ ID NO: 3878 - protein, 34 aa, Artificial
  Consensus peptide
VNTLRCQLGDRLNVEVDAAPTVDLNQVLNETRNQ

SEQ ID NO: 3879 - protein, 34 aa, Artificial
  Consensus peptide
VNTLRSQLGDRLNVEVDAAPTVDLNQVLNETRNQ

SEQ ID NO: 3880 - protein, 34 aa, Artificial
  Consensus peptide
VNTLRCPLGDRLNVEVDAAPTVDLNQVLNETRNQ

SEQ ID NO: 3881 - protein, 34 aa, Artificial
  Consensus peptide
VNTLRSPLGDRLNVEVDAAPTVDLNQVLNETRNQ

SEQ ID NO: 3882 - protein, 34 aa, Artificial
  Consensus peptide
VNTLRCQLGDRLNVEVDTAPTVDLNQVLNETRNQ

SEQ ID NO: 3883 - protein, 34 aa, Artificial
  Consensus peptide
VNTLRSQLGDRLNVEVDTAPTVDLNQVLNETRNQ

SEQ ID NO: 3884 - protein, 34 aa, Artificial
  Consensus peptide
VNTLRCPLGDRLNVEVDTAPTVDLNQVLNETRNQ

SEQ ID NO: 3885 - protein, 34 aa, Artificial
  Consensus peptide
VNTLRSPLGDRLNVEVDTAPTVDLNQVLNETRNQ

SEQ ID NO: 3886 - protein, 34 aa, Artificial
  Consensus peptide
VNTLRCQLGDRLNVEVDAAPTVDLNRVLNETRNQ

SEQ ID NO: 3887 - protein, 34 aa, Artificial
  Consensus peptide
VNTLRSQLGDRLNVEVDAAPTVDLNRVLNETRNQ

SEQ ID NO: 3888 - protein, 34 aa, Artificial
  Consensus peptide
VNTLRCPLGDRLNVEVDAAPTVDLNRVLNETRNQ

SEQ ID NO: 3889 - protein, 34 aa, Artificial
  Consensus peptide
VNTLRSPLGDRLNVEVDAAPTVDLNRVLNETRNQ

SEQ ID NO: 3890 - protein, 34 aa, Artificial
  Consensus peptide
VNTLRCQLGDRLNVEVDTAPTVDLNRVLNETRNQ

SEQ ID NO: 3891 - protein, 34 aa, Artificial
  Consensus peptide
VNTLRSQLGDRLNVEVDTAPTVDLNRVLNETRNQ

SEQ ID NO: 3892 - protein, 34 aa, Artificial
  Consensus peptide
VNTLRCPLGDRLNVEVDTAPTVDLNRVLNETRNQ

SEQ ID NO: 3893 - protein, 34 aa, Artificial
  Consensus peptide
VNTLRSPLGDRLNVEVDTAPTVDLNRVLNETRNQ

SEQ ID NO: 3894 - protein, 34 aa, Artificial
  Consensus peptide
NTLRCQLGDRLNVEVDAAPTVDLNQVLNETRSQY

SEQ ID NO: 3895 - protein, 34 aa, Artificial
  Consensus peptide
NTLRSQLGDRLNVEVDAAPTVDLNQVLNETRSQY

SEQ ID NO: 3896 - protein, 34 aa, Artificial
  Consensus peptide
NTLRCPLGDRLNVEVDAAPTVDLNQVLNETRSQY

SEQ ID NO: 3897 - protein, 34 aa, Artificial
  Consensus peptide
NTLRSPLGDRLNVEVDAAPTVDLNQVLNETRSQY

SEQ ID NO: 3898 - protein, 34 aa, Artificial
  Consensus peptide
NTLRCQLGDRLNVEVDTAPTVDLNQVLNETRSQY

SEQ ID NO: 3899 - protein, 34 aa, Artificial
  Consensus peptide
NTLRSQLGDRLNVEVDTAPTVDLNQVLNETRSQY

SEQ ID NO: 3900 - protein, 34 aa, Artificial
  Consensus peptide
NTLRCPLGDRLNVEVDTAPTVDLNQVLNETRSQY

SEQ ID NO: 3901 - protein, 34 aa, Artificial
  Consensus peptide
NTLRSPLGDRLNVEVDTAPTVDLNQVLNETRSQY

SEQ ID NO: 3902 - protein, 34 aa, Artificial
  Consensus peptide
NTLRCQLGDRLNVEVDAAPTVDLNRVLNETRSQY

SEQ ID NO: 3903 - protein, 34 aa, Artificial
  Consensus peptide
NTLRSQLGDRLNVEVDAAPTVDLNRVLNETRSQY

SEQ ID NO: 3904 - protein, 34 aa, Artificial
  Consensus peptide
NTLRCPLGDRLNVEVDAAPTVDLNRVLNETRSQY

SEQ ID NO: 3905 - protein, 34 aa, Artificial
  Consensus peptide
NTLRSPLGDRLNVEVDAAPTVDLNRVLNETRSQY

SEQ ID NO: 3906 - protein, 34 aa, Artificial
  Consensus peptide
NTLRCQLGDRLNVEVDTAPTVDLNRVLNETRSQY

SEQ ID NO: 3907 - protein, 34 aa, Artificial
  Consensus peptide
NTLRSQLGDRLNVEVDTAPTVDLNRVLNETRSQY

SEQ ID NO: 3908 - protein, 34 aa, Artificial
  Consensus peptide
NTLRCPLGDRLNVEVDTAPTVDLNRVLNETRSQY

SEQ ID NO: 3909 - protein, 34 aa, Artificial
  Consensus peptide
NTLRSPLGDRLNVEVDTAPTVDLNRVLNETRSQY

SEQ ID NO: 3910 - protein, 34 aa, Artificial
  Consensus peptide
NTLRCQLGDRLNVEVDAAPTVDLNQVLNETRNQY

SEQ ID NO: 3911 - protein, 34 aa, Artificial
  Consensus peptide
NTLRSQLGDRLNVEVDAAPTVDLNQVLNETRNQY

SEQ ID NO: 3912 - protein, 34 aa, Artificial
  Consensus peptide
NTLRCPLGDRLNVEVDAAPTVDLNQVLNETRNQY

SEQ ID NO: 3913 - protein, 34 aa, Artificial
  Consensus peptide
NTLRSPLGDRLNVEVDAAPTVDLNQVLNETRNQY

SEQ ID NO: 3914 - protein, 34 aa, Artificial
  Consensus peptide
NTLRCQLGDRLNVEVDTAPTVDLNQVLNETRNQY

SEQ ID NO: 3915 - protein, 34 aa, Artificial
  Consensus peptide
NTLRSQLGDRLNVEVDTAPTVDLNQVLNETRNQY

SEQ ID NO: 3916 - protein, 34 aa, Artificial
  Consensus peptide
NTLRCPLGDRLNVEVDTAPTVDLNQVLNETRNQY

SEQ ID NO: 3917 - protein, 34 aa, Artificial
  Consensus peptide
NTLRSPLGDRLNVEVDTAPTVDLNQVLNETRNQY

SEQ ID NO: 3918 - protein, 34 aa, Artificial
  Consensus peptide
NTLRCQLGDRLNVEVDAAPTVDLNRVLNETRNQY

SEQ ID NO: 3919 - protein, 34 aa, Artificial
  Consensus peptide
NTLRSQLGDRLNVEVDAAPTVDLNRVLNETRNQY

SEQ ID NO: 3920 - protein, 34 aa, Artificial
  Consensus peptide
NTLRCPLGDRLNVEVDAAPTVDLNRVLNETRNQY

SEQ ID NO: 3921 - protein, 34 aa, Artificial
  Consensus peptide
NTLRSPLGDRLNVEVDAAPTVDLNRVLNETRNQY

SEQ ID NO: 3922 - protein, 34 aa, Artificial
  Consensus peptide
NTLRCQLGDRLNVEVDTAPTVDLNRVLNETRNQY

SEQ ID NO: 3923 - protein, 34 aa, Artificial
  Consensus peptide
NTLRSQLGDRLNVEVDTAPTVDLNRVLNETRNQY

SEQ ID NO: 3924 - protein, 34 aa, Artificial
  Consensus peptide
NTLRCPLGDRLNVEVDTAPTVDLNRVLNETRNQY

SEQ ID NO: 3925 - protein, 34 aa, Artificial
  Consensus peptide
NTLRSPLGDRLNVEVDTAPTVDLNRVLNETRNQY

SEQ ID NO: 3926 - protein, 34 aa, Artificial
  Consensus peptide
TLRCQLGDRLNVEVDAAPTVDLNQVLNETRSQYE

SEQ ID NO: 3927 - protein, 34 aa, Artificial
  Consensus peptide
TLRSQLGDRLNVEVDAAPTVDLNQVLNETRSQYE

SEQ ID NO: 3928 - protein, 34 aa, Artificial
  Consensus peptide
TLRCPLGDRLNVEVDAAPTVDLNQVLNETRSQYE

SEQ ID NO: 3929 - protein, 34 aa, Artificial
  Consensus peptide
TLRSPLGDRLNVEVDAAPTVDLNQVLNETRSQYE

SEQ ID NO: 3930 - protein, 34 aa, Artificial
  Consensus peptide
TLRCQLGDRLNVEVDTAPTVDLNQVLNETRSQYE

SEQ ID NO: 3931 - protein, 34 aa, Artificial
  Consensus peptide
TLRSQLGDRLNVEVDTAPTVDLNQVLNETRSQYE

SEQ ID NO: 3932 - protein, 34 aa, Artificial
  Consensus peptide
TLRCPLGDRLNVEVDTAPTVDLNQVLNETRSQYE

SEQ ID NO: 3933 - protein, 34 aa, Artificial
  Consensus peptide
TLRSPLGDRLNVEVDTAPTVDLNQVLNETRSQYE

SEQ ID NO: 3934 - protein, 34 aa, Artificial
  Consensus peptide
TLRCQLGDRLNVEVDAAPTVDLNRVLNETRSQYE

SEQ ID NO: 3935 - protein, 34 aa, Artificial
  Consensus peptide
TLRSQLGDRLNVEVDAAPTVDLNRVLNETRSQYE

SEQ ID NO: 3936 - protein, 34 aa, Artificial
  Consensus peptide
TLRCPLGDRLNVEVDAAPTVDLNRVLNETRSQYE

SEQ ID NO: 3937 - protein, 34 aa, Artificial
  Consensus peptide
TLRSPLGDRLNVEVDAAPTVDLNRVLNETRSQYE

SEQ ID NO: 3938 - protein, 34 aa, Artificial
  Consensus peptide
TLRCQLGDRLNVEVDTAPTVDLNRVLNETRSQYE

SEQ ID NO: 3939 - protein, 34 aa, Artificial
  Consensus peptide
TLRSQLGDRLNVEVDTAPTVDLNRVLNETRSQYE

SEQ ID NO: 3940 - protein, 34 aa, Artificial
  Consensus peptide
TLRCPLGDRLNVEVDTAPTVDLNRVLNETRSQYE

SEQ ID NO: 3941 - protein, 34 aa, Artificial
  Consensus peptide
TLRSPLGDRLNVEVDTAPTVDLNRVLNETRSQYE

SEQ ID NO: 3942 - protein, 34 aa, Artificial
  Consensus peptide
TLRCQLGDRLNVEVDAAPTVDLNQVLNETRNQYE

SEQ ID NO: 3943 - protein, 34 aa, Artificial
  Consensus peptide
TLRSQLGDRLNVEVDAAPTVDLNQVLNETRNQYE

SEQ ID NO: 3944 - protein, 34 aa, Artificial
  Consensus peptide
TLRCPLGDRLNVEVDAAPTVDLNQVLNETRNQYE

SEQ ID NO: 3945 - protein, 34 aa, Artificial
  Consensus peptide
TLRSPLGDRLNVEVDAAPTVDLNQVLNETRNQYE

SEQ ID NO: 3946 - protein, 34 aa, Artificial
  Consensus peptide
TLRCQLGDRLNVEVDTAPTVDLNQVLNETRNQYE

SEQ ID NO: 3947 - protein, 34 aa, Artificial
  Consensus peptide
TLRSQLGDRLNVEVDTAPTVDLNQVLNETRNQYE

SEQ ID NO: 3948 - protein, 34 aa, Artificial
  Consensus peptide
TLRCPLGDRLNVEVDTAPTVDLNQVLNETRNQYE

SEQ ID NO: 3949 - protein, 34 aa, Artificial
  Consensus peptide
TLRSPLGDRLNVEVDTAPTVDLNQVLNETRNQYE

SEQ ID NO: 3950 - protein, 34 aa, Artificial
  Consensus peptide
TLRCQLGDRLNVEVDAAPTVDLNRVLNETRNQYE

SEQ ID NO: 3951 - protein, 34 aa, Artificial
  Consensus peptide
TLRSQLGDRLNVEVDAAPTVDLNRVLNETRNQYE

SEQ ID NO: 3952 - protein, 34 aa, Artificial
  Consensus peptide
TLRCPLGDRLNVEVDAAPTVDLNRVLNETRNQYE

SEQ ID NO: 3953 - protein, 34 aa, Artificial
  Consensus peptide
TLRSPLGDRLNVEVDAAPTVDLNRVLNETRNQYE

SEQ ID NO: 3954 - protein, 34 aa, Artificial
  Consensus peptide
TLRCQLGDRLNVEVDTAPTVDLNRVLNETRNQYE

SEQ ID NO: 3955 - protein, 34 aa, Artificial
  Consensus peptide
TLRSQLGDRLNVEVDTAPTVDLNRVLNETRNQYE

SEQ ID NO: 3956 - protein, 34 aa, Artificial
  Consensus peptide
TLRCPLGDRLNVEVDTAPTVDLNRVLNETRNQYE

SEQ ID NO: 3957 - protein, 34 aa, Artificial
  Consensus peptide
TLRSPLGDRLNVEVDTAPTVDLNRVLNETRNQYE

SEQ ID NO: 3958 - protein, 34 aa, Artificial
  Consensus peptide
LRCQLGDRLNVEVDAAPTVDLNQVLNETRSQYEA

SEQ ID NO: 3959 - protein, 34 aa, Artificial
  Consensus peptide
LRSQLGDRLNVEVDAAPTVDLNQVLNETRSQYEA

SEQ ID NO: 3960 - protein, 34 aa, Artificial
  Consensus peptide
LRCPLGDRLNVEVDAAPTVDLNQVLNETRSQYEA

SEQ ID NO: 3961 - protein, 34 aa, Artificial
  Consensus peptide
LRSPLGDRLNVEVDAAPTVDLNQVLNETRSQYEA

SEQ ID NO: 3962 - protein, 34 aa, Artificial
  Consensus peptide
LRCQLGDRLNVEVDTAPTVDLNQVLNETRSQYEA

SEQ ID NO: 3963 - protein, 34 aa, Artificial
  Consensus peptide
LRSQLGDRLNVEVDTAPTVDLNQVLNETRSQYEA

SEQ ID NO: 3964 - protein, 34 aa, Artificial
  Consensus peptide
LRCPLGDRLNVEVDTAPTVDLNQVLNETRSQYEA

SEQ ID NO: 3965 - protein, 34 aa, Artificial
  Consensus peptide
LRSPLGDRLNVEVDTAPTVDLNQVLNETRSQYEA

SEQ ID NO: 3966 - protein, 34 aa, Artificial
  Consensus peptide
LRCQLGDRLNVEVDAAPTVDLNRVLNETRSQYEA

SEQ ID NO: 3967 - protein, 34 aa, Artificial
  Consensus peptide
LRSQLGDRLNVEVDAAPTVDLNRVLNETRSQYEA

SEQ ID NO: 3968 - protein, 34 aa, Artificial
  Consensus peptide
LRCPLGDRLNVEVDAAPTVDLNRVLNETRSQYEA

SEQ ID NO: 3969 - protein, 34 aa, Artificial
  Consensus peptide
LRSPLGDRLNVEVDAAPTVDLNRVLNETRSQYEA

SEQ ID NO: 3970 - protein, 34 aa, Artificial
  Consensus peptide
LRCQLGDRLNVEVDTAPTVDLNRVLNETRSQYEA

SEQ ID NO: 3971 - protein, 34 aa, Artificial
  Consensus peptide
LRSQLGDRLNVEVDTAPTVDLNRVLNETRSQYEA

SEQ ID NO: 3972 - protein, 34 aa, Artificial
  Consensus peptide
LRCPLGDRLNVEVDTAPTVDLNRVLNETRSQYEA

SEQ ID NO: 3973 - protein, 34 aa, Artificial
  Consensus peptide
LRSPLGDRLNVEVDTAPTVDLNRVLNETRSQYEA

SEQ ID NO: 3974 - protein, 34 aa, Artificial
  Consensus peptide
LRCQLGDRLNVEVDAAPTVDLNQVLNETRNQYEA

SEQ ID NO: 3975 - protein, 34 aa, Artificial
  Consensus peptide
LRSQLGDRLNVEVDAAPTVDLNQVLNETRNQYEA

SEQ ID NO: 3976 - protein, 34 aa, Artificial
  Consensus peptide
LRCPLGDRLNVEVDAAPTVDLNQVLNETRNQYEA

SEQ ID NO: 3977 - protein, 34 aa, Artificial
  Consensus peptide
LRSPLGDRLNVEVDAAPTVDLNQVLNETRNQYEA

SEQ ID NO: 3978 - protein, 34 aa, Artificial
  Consensus peptide
LRCQLGDRLNVEVDTAPTVDLNQVLNETRNQYEA

SEQ ID NO: 3979 - protein, 34 aa, Artificial
  Consensus peptide
LRSQLGDRLNVEVDTAPTVDLNQVLNETRNQYEA

SEQ ID NO: 3980 - protein, 34 aa, Artificial
  Consensus peptide
LRCPLGDRLNVEVDTAPTVDLNQVLNETRNQYEA

SEQ ID NO: 3981 - protein, 34 aa, Artificial
  Consensus peptide
LRSPLGDRLNVEVDTAPTVDLNQVLNETRNQYEA

SEQ ID NO: 3982 - protein, 34 aa, Artificial
  Consensus peptide
LRCQLGDRLNVEVDAAPTVDLNRVLNETRNQYEA

SEQ ID NO: 3983 - protein, 34 aa, Artificial
  Consensus peptide
LRSQLGDRLNVEVDAAPTVDLNRVLNETRNQYEA

SEQ ID NO: 3984 - protein, 34 aa, Artificial
  Consensus peptide
LRCPLGDRLNVEVDAAPTVDLNRVLNETRNQYEA

SEQ ID NO: 3985 - protein, 34 aa, Artificial
  Consensus peptide
LRSPLGDRLNVEVDAAPTVDLNRVLNETRNQYEA

SEQ ID NO: 3986 - protein, 34 aa, Artificial
  Consensus peptide
LRCQLGDRLNVEVDTAPTVDLNRVLNETRNQYEA

SEQ ID NO: 3987 - protein, 34 aa, Artificial
  Consensus peptide
LRSQLGDRLNVEVDTAPTVDLNRVLNETRNQYEA

SEQ ID NO: 3988 - protein, 34 aa, Artificial
  Consensus peptide
LRCPLGDRLNVEVDTAPTVDLNRVLNETRNQYEA

SEQ ID NO: 3989 - protein, 34 aa, Artificial
  Consensus peptide
LRSPLGDRLNVEVDTAPTVDLNRVLNETRNQYEA

SEQ ID NO: 3990 - protein, 34 aa, Artificial
  Consensus peptide
RCQLGDRLNVEVDAAPTVDLNQVLNETRSQYEAL

SEQ ID NO: 3991 - protein, 34 aa, Artificial
  Consensus peptide
RSQLGDRLNVEVDAAPTVDLNQVLNETRSQYEAL

SEQ ID NO: 3992 - protein, 34 aa, Artificial
  Consensus peptide
RCPLGDRLNVEVDAAPTVDLNQVLNETRSQYEAL

SEQ ID NO: 3993 - protein, 34 aa, Artificial
  Consensus peptide
RSPLGDRLNVEVDAAPTVDLNQVLNETRSQYEAL

SEQ ID NO: 3994 - protein, 34 aa, Artificial
  Consensus peptide
RCQLGDRLNVEVDTAPTVDLNQVLNETRSQYEAL

SEQ ID NO: 3995 - protein, 34 aa, Artificial
  Consensus peptide
RSQLGDRLNVEVDTAPTVDLNQVLNETRSQYEAL

SEQ ID NO: 3996 - protein, 34 aa, Artificial
  Consensus peptide
RCPLGDRLNVEVDTAPTVDLNQVLNETRSQYEAL

SEQ ID NO: 3997 - protein, 34 aa, Artificial
  Consensus peptide
RSPLGDRLNVEVDTAPTVDLNQVLNETRSQYEAL

SEQ ID NO: 3998 - protein, 34 aa, Artificial
  Consensus peptide
RCQLGDRLNVEVDAAPTVDLNRVLNETRSQYEAL

SEQ ID NO: 3999 - protein, 34 aa, Artificial
  Consensus peptide
RSQLGDRLNVEVDAAPTVDLNRVLNETRSQYEAL

SEQ ID NO: 4000 - protein, 34 aa, Artificial
  Consensus peptide
RCPLGDRLNVEVDAAPTVDLNRVLNETRSQYEAL

SEQ ID NO: 4001 - protein, 34 aa, Artificial
  Consensus peptide
RSPLGDRLNVEVDAAPTVDLNRVLNETRSQYEAL

SEQ ID NO: 4002 - protein, 34 aa, Artificial
  Consensus peptide
RCQLGDRLNVEVDTAPTVDLNRVLNETRSQYEAL

SEQ ID NO: 4003 - protein, 34 aa, Artificial
  Consensus peptide
RSQLGDRLNVEVDTAPTVDLNRVLNETRSQYEAL

SEQ ID NO: 4004 - protein, 34 aa, Artificial
  Consensus peptide
RCPLGDRLNVEVDTAPTVDLNRVLNETRSQYEAL

SEQ ID NO: 4005 - protein, 34 aa, Artificial
  Consensus peptide
RSPLGDRLNVEVDTAPTVDLNRVLNETRSQYEAL

SEQ ID NO: 4006 - protein, 34 aa, Artificial
  Consensus peptide
RCQLGDRLNVEVDAAPTVDLNQVLNETRNQYEAL

SEQ ID NO: 4007 - protein, 34 aa, Artificial
  Consensus peptide
RSQLGDRLNVEVDAAPTVDLNQVLNETRNQYEAL

SEQ ID NO: 4008 - protein, 34 aa, Artificial
  Consensus peptide
RCPLGDRLNVEVDAAPTVDLNQVLNETRNQYEAL

SEQ ID NO: 4009 - protein, 34 aa, Artificial
  Consensus peptide
RSPLGDRLNVEVDAAPTVDLNQVLNETRNQYEAL

SEQ ID NO: 4010 - protein, 34 aa, Artificial
  Consensus peptide
RCQLGDRLNVEVDTAPTVDLNQVLNETRNQYEAL

SEQ ID NO: 4011 - protein, 34 aa, Artificial
  Consensus peptide
RSQLGDRLNVEVDTAPTVDLNQVLNETRNQYEAL

SEQ ID NO: 4012 - protein, 34 aa, Artificial
  Consensus peptide
RCPLGDRLNVEVDTAPTVDLNQVLNETRNQYEAL

SEQ ID NO: 4013 - protein, 34 aa, Artificial
  Consensus peptide
RSPLGDRLNVEVDTAPTVDLNQVLNETRNQYEAL

SEQ ID NO: 4014 - protein, 34 aa, Artificial
  Consensus peptide
RCQLGDRLNVEVDAAPTVDLNRVLNETRNQYEAL

SEQ ID NO: 4015 - protein, 34 aa, Artificial
  Consensus peptide
RSQLGDRLNVEVDAAPTVDLNRVLNETRNQYEAL

SEQ ID NO: 4016 - protein, 34 aa, Artificial
  Consensus peptide
RCPLGDRLNVEVDAAPTVDLNRVLNETRNQYEAL

SEQ ID NO: 4017 - protein, 34 aa, Artificial
  Consensus peptide
RSPLGDRLNVEVDAAPTVDLNRVLNETRNQYEAL

SEQ ID NO: 4018 - protein, 34 aa, Artificial
  Consensus peptide
RCQLGDRLNVEVDTAPTVDLNRVLNETRNQYEAL

SEQ ID NO: 4019 - protein, 34 aa, Artificial
  Consensus peptide
RSQLGDRLNVEVDTAPTVDLNRVLNETRNQYEAL

SEQ ID NO: 4020 - protein, 34 aa, Artificial
  Consensus peptide
RCPLGDRLNVEVDTAPTVDLNRVLNETRNQYEAL

SEQ ID NO: 4021 - protein, 34 aa, Artificial
  Consensus peptide
RSPLGDRLNVEVDTAPTVDLNRVLNETRNQYEAL

SEQ ID NO: 4022 - protein, 35 aa, Artificial
  Consensus peptide
EVNTLRCQLGDRLNVEVDAAPTVDLNQVLNETRSQ

SEQ ID NO: 4023 - protein, 35 aa, Artificial
  Consensus peptide
EVNTLRSQLGDRLNVEVDAAPTVDLNQVLNETRSQ

SEQ ID NO: 4024 - protein, 35 aa, Artificial
  Consensus peptide
EVNTLRCPLGDRLNVEVDAAPTVDLNQVLNETRSQ

SEQ ID NO: 4025 - protein, 35 aa, Artificial
  Consensus peptide
EVNTLRSPLGDRLNVEVDAAPTVDLNQVLNETRSQ

SEQ ID NO: 4026 - protein, 35 aa, Artificial
  Consensus peptide
EVNTLRCQLGDRLNVEVDTAPTVDLNQVLNETRSQ

SEQ ID NO: 4027 - protein, 35 aa, Artificial
  Consensus peptide
EVNTLRSQLGDRLNVEVDTAPTVDLNQVLNETRSQ

SEQ ID NO: 4028 - protein, 35 aa, Artificial
  Consensus peptide
EVNTLRCPLGDRLNVEVDTAPTVDLNQVLNETRSQ

SEQ ID NO: 4029 - protein, 35 aa, Artificial
  Consensus peptide
EVNTLRSPLGDRLNVEVDTAPTVDLNQVLNETRSQ

SEQ ID NO: 4030 - protein, 35 aa, Artificial
  Consensus peptide
EVNTLRCQLGDRLNVEVDAAPTVDLNRVLNETRSQ

SEQ ID NO: 4031 - protein, 35 aa, Artificial
  Consensus peptide
EVNTLRSQLGDRLNVEVDAAPTVDLNRVLNETRSQ

SEQ ID NO: 4032 - protein, 35 aa, Artificial
  Consensus peptide
EVNTLRCPLGDRLNVEVDAAPTVDLNRVLNETRSQ

SEQ ID NO: 4033 - protein, 35 aa, Artificial
  Consensus peptide
EVNTLRSPLGDRLNVEVDAAPTVDLNRVLNETRSQ

SEQ ID NO: 4034 - protein, 35 aa, Artificial
  Consensus peptide
EVNTLRCQLGDRLNVEVDTAPTVDLNRVLNETRSQ

SEQ ID NO: 4035 - protein, 35 aa, Artificial
  Consensus peptide
EVNTLRSQLGDRLNVEVDTAPTVDLNRVLNETRSQ

SEQ ID NO: 4036 - protein, 35 aa, Artificial
  Consensus peptide
EVNTLRCPLGDRLNVEVDTAPTVDLNRVLNETRSQ

SEQ ID NO: 4037 - protein, 35 aa, Artificial
  Consensus peptide
EVNTLRSPLGDRLNVEVDTAPTVDLNRVLNETRSQ

SEQ ID NO: 4038 - protein, 35 aa, Artificial
  Consensus peptide
EVNTLRCQLGDRLNVEVDAAPTVDLNQVLNETRNQ

SEQ ID NO: 4039 - protein, 35 aa, Artificial
  Consensus peptide
EVNTLRSQLGDRLNVEVDAAPTVDLNQVLNETRNQ

SEQ ID NO: 4040 - protein, 35 aa, Artificial
  Consensus peptide
EVNTLRCPLGDRLNVEVDAAPTVDLNQVLNETRNQ

SEQ ID NO: 4041 - protein, 35 aa, Artificial
  Consensus peptide
EVNTLRSPLGDRLNVEVDAAPTVDLNQVLNETRNQ

SEQ ID NO: 4042 - protein, 35 aa, Artificial
  Consensus peptide
EVNTLRCQLGDRLNVEVDTAPTVDLNQVLNETRNQ

SEQ ID NO: 4043 - protein, 35 aa, Artificial
  Consensus peptide
EVNTLRSQLGDRLNVEVDTAPTVDLNQVLNETRNQ

SEQ ID NO: 4044 - protein, 35 aa, Artificial
  Consensus peptide
EVNTLRCPLGDRLNVEVDTAPTVDLNQVLNETRNQ

SEQ ID NO: 4045 - protein, 35 aa, Artificial
  Consensus peptide
EVNTLRSPLGDRLNVEVDTAPTVDLNQVLNETRNQ

SEQ ID NO: 4046 - protein, 35 aa, Artificial
  Consensus peptide
EVNTLRCQLGDRLNVEVDAAPTVDLNRVLNETRNQ

SEQ ID NO: 4047 - protein, 35 aa, Artificial
  Consensus peptide
EVNTLRSQLGDRLNVEVDAAPTVDLNRVLNETRNQ

SEQ ID NO: 4048 - protein, 35 aa, Artificial
  Consensus peptide
EVNTLRCPLGDRLNVEVDAAPTVDLNRVLNETRNQ

SEQ ID NO: 4049 - protein, 35 aa, Artificial
  Consensus peptide
EVNTLRSPLGDRLNVEVDAAPTVDLNRVLNETRNQ

SEQ ID NO: 4050 - protein, 35 aa, Artificial
  Consensus peptide
EVNTLRCQLGDRLNVEVDTAPTVDLNRVLNETRNQ

SEQ ID NO: 4051 - protein, 35 aa, Artificial
  Consensus peptide
EVNTLRSQLGDRLNVEVDTAPTVDLNRVLNETRNQ

SEQ ID NO: 4052 - protein, 35 aa, Artificial
  Consensus peptide
EVNTLRCPLGDRLNVEVDTAPTVDLNRVLNETRNQ

SEQ ID NO: 4053 - protein, 35 aa, Artificial
  Consensus peptide
EVNTLRSPLGDRLNVEVDTAPTVDLNRVLNETRNQ

SEQ ID NO: 4054 - protein, 35 aa, Artificial
  Consensus peptide
VNTLRCQLGDRLNVEVDAAPTVDLNQVLNETRSQY

SEQ ID NO: 4055 - protein, 35 aa, Artificial
  Consensus peptide
VNTLRSQLGDRLNVEVDAAPTVDLNQVLNETRSQY

SEQ ID NO: 4056 - protein, 35 aa, Artificial
  Consensus peptide
VNTLRCPLGDRLNVEVDAAPTVDLNQVLNETRSQY

SEQ ID NO: 4057 - protein, 35 aa, Artificial
  Consensus peptide
VNTLRSPLGDRLNVEVDAAPTVDLNQVLNETRSQY

SEQ ID NO: 4058 - protein, 35 aa, Artificial
  Consensus peptide
VNTLRCQLGDRLNVEVDTAPTVDLNQVLNETRSQY

SEQ ID NO: 4059 - protein, 35 aa, Artificial
  Consensus peptide
VNTLRSQLGDRLNVEVDTAPTVDLNQVLNETRSQY

SEQ ID NO: 4060 - protein, 35 aa, Artificial
  Consensus peptide
VNTLRCPLGDRLNVEVDTAPTVDLNQVLNETRSQY

SEQ ID NO: 4061 - protein, 35 aa, Artificial
  Consensus peptide
VNTLRSPLGDRLNVEVDTAPTVDLNQVLNETRSQY

SEQ ID NO: 4062 - protein, 35 aa, Artificial
  Consensus peptide
VNTLRCQLGDRLNVEVDAAPTVDLNRVLNETRSQY

SEQ ID NO: 4063 - protein, 35 aa, Artificial
  Consensus peptide
VNTLRSQLGDRLNVEVDAAPTVDLNRVLNETRSQY

SEQ ID NO: 4064 - protein, 35 aa, Artificial
  Consensus peptide
VNTLRCPLGDRLNVEVDAAPTVDLNRVLNETRSQY

SEQ ID NO: 4065 - protein, 35 aa, Artificial
  Consensus peptide
VNTLRSPLGDRLNVEVDAAPTVDLNRVLNETRSQY

SEQ ID NO: 4066 - protein, 35 aa, Artificial
  Consensus peptide
VNTLRCQLGDRLNVEVDTAPTVDLNRVLNETRSQY

SEQ ID NO: 4067 - protein, 35 aa, Artificial
  Consensus peptide
VNTLRSQLGDRLNVEVDTAPTVDLNRVLNETRSQY

SEQ ID NO: 4068 - protein, 35 aa, Artificial
  Consensus peptide
VNTLRCPLGDRLNVEVDTAPTVDLNRVLNETRSQY

SEQ ID NO: 4069 - protein, 35 aa, Artificial
  Consensus peptide
VNTLRSPLGDRLNVEVDTAPTVDLNRVLNETRSQY

SEQ ID NO: 4070 - protein, 35 aa, Artificial
  Consensus peptide
VNTLRCQLGDRLNVEVDAAPTVDLNQVLNETRNQY

SEQ ID NO: 4071 - protein, 35 aa, Artificial
  Consensus peptide
VNTLRSQLGDRLNVEVDAAPTVDLNQVLNETRNQY

SEQ ID NO: 4072 - protein, 35 aa, Artificial
  Consensus peptide
VNTLRCPLGDRLNVEVDAAPTVDLNQVLNETRNQY

SEQ ID NO: 4073 - protein, 35 aa, Artificial
  Consensus peptide
VNTLRSPLGDRLNVEVDAAPTVDLNQVLNETRNQY

SEQ ID NO: 4074 - protein, 35 aa, Artificial
  Consensus peptide
VNTLRCQLGDRLNVEVDTAPTVDLNQVLNETRNQY

SEQ ID NO: 4075 - protein, 35 aa, Artificial
  Consensus peptide
VNTLRSQLGDRLNVEVDTAPTVDLNQVLNETRNQY

SEQ ID NO: 4076 - protein, 35 aa, Artificial
  Consensus peptide
VNTLRCPLGDRLNVEVDTAPTVDLNQVLNETRNQY

SEQ ID NO: 4077 - protein, 35 aa, Artificial
  Consensus peptide
VNTLRSPLGDRLNVEVDTAPTVDLNQVLNETRNQY

SEQ ID NO: 4078 - protein, 35 aa, Artificial
  Consensus peptide
VNTLRCQLGDRLNVEVDAAPTVDLNRVLNETRNQY

SEQ ID NO: 4079 - protein, 35 aa, Artificial
  Consensus peptide
VNTLRSQLGDRLNVEVDAAPTVDLNRVLNETRNQY

SEQ ID NO: 4080 - protein, 35 aa, Artificial
  Consensus peptide
VNTLRCPLGDRLNVEVDAAPTVDLNRVLNETRNQY

SEQ ID NO: 4081 - protein, 35 aa, Artificial
  Consensus peptide
VNTLRSPLGDRLNVEVDAAPTVDLNRVLNETRNQY

SEQ ID NO: 4082 - protein, 35 aa, Artificial
  Consensus peptide
VNTLRCQLGDRLNVEVDTAPTVDLNRVLNETRNQY

SEQ ID NO: 4083 - protein, 35 aa, Artificial
  Consensus peptide
VNTLRSQLGDRLNVEVDTAPTVDLNRVLNETRNQY

SEQ ID NO: 4084 - protein, 35 aa, Artificial
  Consensus peptide
VNTLRCPLGDRLNVEVDTAPTVDLNRVLNETRNQY

SEQ ID NO: 4085 - protein, 35 aa, Artificial
  Consensus peptide
VNTLRSPLGDRLNVEVDTAPTVDLNRVLNETRNQY

SEQ ID NO: 4086 - protein, 35 aa, Artificial
  Consensus peptide
NTLRCQLGDRLNVEVDAAPTVDLNQVLNETRSQYE

SEQ ID NO: 4087 - protein, 35 aa, Artificial
  Consensus peptide
NTLRSQLGDRLNVEVDAAPTVDLNQVLNETRSQYE

SEQ ID NO: 4088 - protein, 35 aa, Artificial
  Consensus peptide
NTLRCPLGDRLNVEVDAAPTVDLNQVLNETRSQYE

SEQ ID NO: 4089 - protein, 35 aa, Artificial
  Consensus peptide
NTLRSPLGDRLNVEVDAAPTVDLNQVLNETRSQYE

SEQ ID NO: 4090 - protein, 35 aa, Artificial
  Consensus peptide
NTLRCQLGDRLNVEVDTAPTVDLNQVLNETRSQYE

SEQ ID NO: 4091 - protein, 35 aa, Artificial
  Consensus peptide
NTLRSQLGDRLNVEVDTAPTVDLNQVLNETRSQYE

SEQ ID NO: 4092 - protein, 35 aa, Artificial
  Consensus peptide
NTLRCPLGDRLNVEVDTAPTVDLNQVLNETRSQYE

SEQ ID NO: 4093 - protein, 35 aa, Artificial
  Consensus peptide
NTLRSPLGDRLNVEVDTAPTVDLNQVLNETRSQYE

SEQ ID NO: 4094 - protein, 35 aa, Artificial
  Consensus peptide
NTLRCQLGDRLNVEVDAAPTVDLNRVLNETRSQYE

SEQ ID NO: 4095 - protein, 35 aa, Artificial
  Consensus peptide
NTLRSQLGDRLNVEVDAAPTVDLNRVLNETRSQYE

SEQ ID NO: 4096 - protein, 35 aa, Artificial
  Consensus peptide
NTLRCPLGDRLNVEVDAAPTVDLNRVLNETRSQYE

SEQ ID NO: 4097 - protein, 35 aa, Artificial
  Consensus peptide
NTLRSPLGDRLNVEVDAAPTVDLNRVLNETRSQYE

SEQ ID NO: 4098 - protein, 35 aa, Artificial
  Consensus peptide
NTLRCQLGDRLNVEVDTAPTVDLNRVLNETRSQYE

SEQ ID NO: 4099 - protein, 35 aa, Artificial
  Consensus peptide
NTLRSQLGDRLNVEVDTAPTVDLNRVLNETRSQYE

SEQ ID NO: 4100 - protein, 35 aa, Artificial
  Consensus peptide
NTLRCPLGDRLNVEVDTAPTVDLNRVLNETRSQYE

SEQ ID NO: 4101 - protein, 35 aa, Artificial
  Consensus peptide
NTLRSPLGDRLNVEVDTAPTVDLNRVLNETRSQYE

SEQ ID NO: 4102 - protein, 35 aa, Artificial
  Consensus peptide
NTLRCQLGDRLNVEVDAAPTVDLNQVLNETRNQYE

SEQ ID NO: 4103 - protein, 35 aa, Artificial
  Consensus peptide
NTLRSQLGDRLNVEVDAAPTVDLNQVLNETRNQYE

SEQ ID NO: 4104 - protein, 35 aa, Artificial
  Consensus peptide
NTLRCPLGDRLNVEVDAAPTVDLNQVLNETRNQYE

SEQ ID NO: 4105 - protein, 35 aa, Artificial
  Consensus peptide
NTLRSPLGDRLNVEVDAAPTVDLNQVLNETRNQYE

SEQ ID NO: 4106 - protein, 35 aa, Artificial
  Consensus peptide
NTLRCQLGDRLNVEVDTAPTVDLNQVLNETRNQYE

SEQ ID NO: 4107 - protein, 35 aa, Artificial
  Consensus peptide
NTLRSQLGDRLNVEVDTAPTVDLNQVLNETRNQYE

SEQ ID NO: 4108 - protein, 35 aa, Artificial
  Consensus peptide
NTLRCPLGDRLNVEVDTAPTVDLNQVLNETRNQYE

SEQ ID NO: 4109 - protein, 35 aa, Artificial
  Consensus peptide
NTLRSPLGDRLNVEVDTAPTVDLNQVLNETRNQYE

SEQ ID NO: 4110 - protein, 35 aa, Artificial
  Consensus peptide
NTLRCQLGDRLNVEVDAAPTVDLNRVLNETRNQYE

SEQ ID NO: 4111 - protein, 35 aa, Artificial
  Consensus peptide
NTLRSQLGDRLNVEVDAAPTVDLNRVLNETRNQYE

SEQ ID NO: 4112 - protein, 35 aa, Artificial
  Consensus peptide
NTLRCPLGDRLNVEVDAAPTVDLNRVLNETRNQYE

SEQ ID NO: 4113 - protein, 35 aa, Artificial
  Consensus peptide
NTLRSPLGDRLNVEVDAAPTVDLNRVLNETRNQYE

SEQ ID NO: 4114 - protein, 35 aa, Artificial
  Consensus peptide
NTLRCQLGDRLNVEVDTAPTVDLNRVLNETRNQYE

SEQ ID NO: 4115 - protein, 35 aa, Artificial
  Consensus peptide
NTLRSQLGDRLNVEVDTAPTVDLNRVLNETRNQYE

SEQ ID NO: 4116 - protein, 35 aa, Artificial
  Consensus peptide
NTLRCPLGDRLNVEVDTAPTVDLNRVLNETRNQYE

SEQ ID NO: 4117 - protein, 35 aa, Artificial
  Consensus peptide
NTLRSPLGDRLNVEVDTAPTVDLNRVLNETRNQYE

SEQ ID NO: 4118 - protein, 35 aa, Artificial
  Consensus peptide
TLRCQLGDRLNVEVDAAPTVDLNQVLNETRSQYEA

SEQ ID NO: 4119 - protein, 35 aa, Artificial
  Consensus peptide
TLRSQLGDRLNVEVDAAPTVDLNQVLNETRSQYEA

SEQ ID NO: 4120 - protein, 35 aa, Artificial
  Consensus peptide
TLRCPLGDRLNVEVDAAPTVDLNQVLNETRSQYEA

SEQ ID NO: 4121 - protein, 35 aa, Artificial
  Consensus peptide
TLRSPLGDRLNVEVDAAPTVDLNQVLNETRSQYEA

SEQ ID NO: 4122 - protein, 35 aa, Artificial
  Consensus peptide
TLRCQLGDRLNVEVDTAPTVDLNQVLNETRSQYEA

SEQ ID NO: 4123 - protein, 35 aa, Artificial
  Consensus peptide
TLRSQLGDRLNVEVDTAPTVDLNQVLNETRSQYEA

SEQ ID NO: 4124 - protein, 35 aa, Artificial
  Consensus peptide
TLRCPLGDRLNVEVDTAPTVDLNQVLNETRSQYEA

SEQ ID NO: 4125 - protein, 35 aa, Artificial
  Consensus peptide
TLRSPLGDRLNVEVDTAPTVDLNQVLNETRSQYEA

SEQ ID NO: 4126 - protein, 35 aa, Artificial
  Consensus peptide
TLRCQLGDRLNVEVDAAPTVDLNRVLNETRSQYEA

SEQ ID NO: 4127 - protein, 35 aa, Artificial
  Consensus peptide
TLRSQLGDRLNVEVDAAPTVDLNRVLNETRSQYEA

SEQ ID NO: 4128 - protein, 35 aa, Artificial
  Consensus peptide
TLRCPLGDRLNVEVDAAPTVDLNRVLNETRSQYEA

SEQ ID NO: 4129 - protein, 35 aa, Artificial
  Consensus peptide
TLRSPLGDRLNVEVDAAPTVDLNRVLNETRSQYEA

SEQ ID NO: 4130 - protein, 35 aa, Artificial
  Consensus peptide
TLRCQLGDRLNVEVDTAPTVDLNRVLNETRSQYEA

SEQ ID NO: 4131 - protein, 35 aa, Artificial
  Consensus peptide
TLRSQLGDRLNVEVDTAPTVDLNRVLNETRSQYEA

SEQ ID NO: 4132 - protein, 35 aa, Artificial
  Consensus peptide
TLRCPLGDRLNVEVDTAPTVDLNRVLNETRSQYEA

SEQ ID NO: 4133 - protein, 35 aa, Artificial
  Consensus peptide
TLRSPLGDRLNVEVDTAPTVDLNRVLNETRSQYEA

SEQ ID NO: 4134 - protein, 35 aa, Artificial
  Consensus peptide
TLRCQLGDRLNVEVDAAPTVDLNQVLNETRNQYEA

SEQ ID NO: 4135 - protein, 35 aa, Artificial
  Consensus peptide
TLRSQLGDRLNVEVDAAPTVDLNQVLNETRNQYEA

SEQ ID NO: 4136 - protein, 35 aa, Artificial
  Consensus peptide
TLRCPLGDRLNVEVDAAPTVDLNQVLNETRNQYEA

SEQ ID NO: 4137 - protein, 35 aa, Artificial
  Consensus peptide
TLRSPLGDRLNVEVDAAPTVDLNQVLNETRNQYEA

SEQ ID NO: 4138 - protein, 35 aa, Artificial
  Consensus peptide
TLRCQLGDRLNVEVDTAPTVDLNQVLNETRNQYEA

SEQ ID NO: 4139 - protein, 35 aa, Artificial
  Consensus peptide
TLRSQLGDRLNVEVDTAPTVDLNQVLNETRNQYEA

SEQ ID NO: 4140 - protein, 35 aa, Artificial
  Consensus peptide
TLRCPLGDRLNVEVDTAPTVDLNQVLNETRNQYEA

SEQ ID NO: 4141 - protein, 35 aa, Artificial
  Consensus peptide
TLRSPLGDRLNVEVDTAPTVDLNQVLNETRNQYEA

SEQ ID NO: 4142 - protein, 35 aa, Artificial
  Consensus peptide
TLRCQLGDRLNVEVDAAPTVDLNRVLNETRNQYEA

SEQ ID NO: 4143 - protein, 35 aa, Artificial
  Consensus peptide
TLRSQLGDRLNVEVDAAPTVDLNRVLNETRNQYEA

SEQ ID NO: 4144 - protein, 35 aa, Artificial
  Consensus peptide
TLRCPLGDRLNVEVDAAPTVDLNRVLNETRNQYEA

SEQ ID NO: 4145 - protein, 35 aa, Artificial
  Consensus peptide
TLRSPLGDRLNVEVDAAPTVDLNRVLNETRNQYEA

SEQ ID NO: 4146 - protein, 35 aa, Artificial
  Consensus peptide
TLRCQLGDRLNVEVDTAPTVDLNRVLNETRNQYEA

SEQ ID NO: 4147 - protein, 35 aa, Artificial
  Consensus peptide
TLRSQLGDRLNVEVDTAPTVDLNRVLNETRNQYEA

SEQ ID NO: 4148 - protein, 35 aa, Artificial
  Consensus peptide
TLRCPLGDRLNVEVDTAPTVDLNRVLNETRNQYEA

SEQ ID NO: 4149 - protein, 35 aa, Artificial
  Consensus peptide
TLRSPLGDRLNVEVDTAPTVDLNRVLNETRNQYEA

SEQ ID NO: 4150 - protein, 35 aa, Artificial
  Consensus peptide
LRCQLGDRLNVEVDAAPTVDLNQVLNETRSQYEAL

SEQ ID NO: 4151 - protein, 35 aa, Artificial
  Consensus peptide
LRSQLGDRLNVEVDAAPTVDLNQVLNETRSQYEAL

SEQ ID NO: 4152 - protein, 35 aa, Artificial
  Consensus peptide
LRCPLGDRLNVEVDAAPTVDLNQVLNETRSQYEAL

SEQ ID NO: 4153 - protein, 35 aa, Artificial
  Consensus peptide
LRSPLGDRLNVEVDAAPTVDLNQVLNETRSQYEAL

SEQ ID NO: 4154 - protein, 35 aa, Artificial
  Consensus peptide
LRCQLGDRLNVEVDTAPTVDLNQVLNETRSQYEAL

SEQ ID NO: 4155 - protein, 35 aa, Artificial
  Consensus peptide
LRSQLGDRLNVEVDTAPTVDLNQVLNETRSQYEAL

SEQ ID NO: 4156 - protein, 35 aa, Artificial
  Consensus peptide
LRCPLGDRLNVEVDTAPTVDLNQVLNETRSQYEAL

SEQ ID NO: 4157 - protein, 35 aa, Artificial
  Consensus peptide
LRSPLGDRLNVEVDTAPTVDLNQVLNETRSQYEAL

SEQ ID NO: 4158 - protein, 35 aa, Artificial
  Consensus peptide
LRCQLGDRLNVEVDAAPTVDLNRVLNETRSQYEAL

SEQ ID NO: 4159 - protein, 35 aa, Artificial
  Consensus peptide
LRSQLGDRLNVEVDAAPTVDLNRVLNETRSQYEAL

SEQ ID NO: 4160 - protein, 35 aa, Artificial
  Consensus peptide
LRCPLGDRLNVEVDAAPTVDLNRVLNETRSQYEAL

SEQ ID NO: 4161 - protein, 35 aa, Artificial
  Consensus peptide
LRSPLGDRLNVEVDAAPTVDLNRVLNETRSQYEAL

SEQ ID NO: 4162 - protein, 35 aa, Artificial
  Consensus peptide
LRCQLGDRLNVEVDTAPTVDLNRVLNETRSQYEAL

SEQ ID NO: 4163 - protein, 35 aa, Artificial
  Consensus peptide
LRSQLGDRLNVEVDTAPTVDLNRVLNETRSQYEAL

SEQ ID NO: 4164 - protein, 35 aa, Artificial
  Consensus peptide
LRCPLGDRLNVEVDTAPTVDLNRVLNETRSQYEAL

SEQ ID NO: 4165 - protein, 35 aa, Artificial
  Consensus peptide
LRSPLGDRLNVEVDTAPTVDLNRVLNETRSQYEAL

SEQ ID NO: 4166 - protein, 35 aa, Artificial
  Consensus peptide
LRCQLGDRLNVEVDAAPTVDLNQVLNETRNQYEAL

SEQ ID NO: 4167 - protein, 35 aa, Artificial
  Consensus peptide
LRSQLGDRLNVEVDAAPTVDLNQVLNETRNQYEAL

SEQ ID NO: 4168 - protein, 35 aa, Artificial
  Consensus peptide
LRCPLGDRLNVEVDAAPTVDLNQVLNETRNQYEAL

SEQ ID NO: 4169 - protein, 35 aa, Artificial
  Consensus peptide
LRSPLGDRLNVEVDAAPTVDLNQVLNETRNQYEAL

SEQ ID NO: 4170 - protein, 35 aa, Artificial
  Consensus peptide
LRCQLGDRLNVEVDTAPTVDLNQVLNETRNQYEAL

SEQ ID NO: 4171 - protein, 35 aa, Artificial
  Consensus peptide
LRSQLGDRLNVEVDTAPTVDLNQVLNETRNQYEAL

SEQ ID NO: 4172 - protein, 35 aa, Artificial
  Consensus peptide
LRCPLGDRLNVEVDTAPTVDLNQVLNETRNQYEAL

SEQ ID NO: 4173 - protein, 35 aa, Artificial
  Consensus peptide
LRSPLGDRLNVEVDTAPTVDLNQVLNETRNQYEAL

SEQ ID NO: 4174 - protein, 35 aa, Artificial
  Consensus peptide
LRCQLGDRLNVEVDAAPTVDLNRVLNETRNQYEAL

SEQ ID NO: 4175 - protein, 35 aa, Artificial
  Consensus peptide
LRSQLGDRLNVEVDAAPTVDLNRVLNETRNQYEAL

SEQ ID NO: 4176 - protein, 35 aa, Artificial
  Consensus peptide
LRCPLGDRLNVEVDAAPTVDLNRVLNETRNQYEAL

SEQ ID NO: 4177 - protein, 35 aa, Artificial
  Consensus peptide
LRSPLGDRLNVEVDAAPTVDLNRVLNETRNQYEAL

SEQ ID NO: 4178 - protein, 35 aa, Artificial
  Consensus peptide
LRCQLGDRLNVEVDTAPTVDLNRVLNETRNQYEAL

SEQ ID NO: 4179 - protein, 35 aa, Artificial
  Consensus peptide
LRSQLGDRLNVEVDTAPTVDLNRVLNETRNQYEAL

SEQ ID NO: 4180 - protein, 35 aa, Artificial
  Consensus peptide
LRCPLGDRLNVEVDTAPTVDLNRVLNETRNQYEAL

SEQ ID NO: 4181 - protein, 35 aa, Artificial
  Consensus peptide
LRSPLGDRLNVEVDTAPTVDLNRVLNETRNQYEAL

SEQ ID NO: 4182 - protein, 36 aa, Artificial
  Consensus peptide
EVNTLRCQLGDRLNVEVDAAPTVDLNQVLNETRSQY

SEQ ID NO: 4183 - protein, 36 aa, Artificial
  Consensus peptide
EVNTLRSQLGDRLNVEVDAAPTVDLNQVLNETRSQY

SEQ ID NO: 4184 - protein, 36 aa, Artificial
  Consensus peptide
EVNTLRCPLGDRLNVEVDAAPTVDLNQVLNETRSQY

SEQ ID NO: 4185 - protein, 36 aa, Artificial
  Consensus peptide
EVNTLRSPLGDRLNVEVDAAPTVDLNQVLNETRSQY

SEQ ID NO: 4186 - protein, 36 aa, Artificial
  Consensus peptide
EVNTLRCQLGDRLNVEVDTAPTVDLNQVLNETRSQY

SEQ ID NO: 4187 - protein, 36 aa, Artificial
  Consensus peptide
EVNTLRSQLGDRLNVEVDTAPTVDLNQVLNETRSQY

SEQ ID NO: 4188 - protein, 36 aa, Artificial
  Consensus peptide
EVNTLRCPLGDRLNVEVDTAPTVDLNQVLNETRSQY

SEQ ID NO: 4189 - protein, 36 aa, Artificial
  Consensus peptide
EVNTLRSPLGDRLNVEVDTAPTVDLNQVLNETRSQY

SEQ ID NO: 4190 - protein, 36 aa, Artificial
  Consensus peptide
EVNTLRCQLGDRLNVEVDAAPTVDLNRVLNETRSQY

SEQ ID NO: 4191 - protein, 36 aa, Artificial
  Consensus peptide
EVNTLRSQLGDRLNVEVDAAPTVDLNRVLNETRSQY

SEQ ID NO: 4192 - protein, 36 aa, Artificial
  Consensus peptide
EVNTLRCPLGDRLNVEVDAAPTVDLNRVLNETRSQY

SEQ ID NO: 4193 - protein, 36 aa, Artificial
  Consensus peptide
EVNTLRSPLGDRLNVEVDAAPTVDLNRVLNETRSQY

SEQ ID NO: 4194 - protein, 36 aa, Artificial
  Consensus peptide
EVNTLRCQLGDRLNVEVDTAPTVDLNRVLNETRSQY

SEQ ID NO: 4195 - protein, 36 aa, Artificial
  Consensus peptide
EVNTLRSQLGDRLNVEVDTAPTVDLNRVLNETRSQY

SEQ ID NO: 4196 - protein, 36 aa, Artificial
  Consensus peptide
EVNTLRCPLGDRLNVEVDTAPTVDLNRVLNETRSQY

SEQ ID NO: 4197 - protein, 36 aa, Artificial
  Consensus peptide
EVNTLRSPLGDRLNVEVDTAPTVDLNRVLNETRSQY

SEQ ID NO: 4198 - protein, 36 aa, Artificial
  Consensus peptide
EVNTLRCQLGDRLNVEVDAAPTVDLNQVLNETRNQY

SEQ ID NO: 4199 - protein, 36 aa, Artificial
  Consensus peptide
EVNTLRSQLGDRLNVEVDAAPTVDLNQVLNETRNQY

SEQ ID NO: 4200 - protein, 36 aa, Artificial
  Consensus peptide
EVNTLRCPLGDRLNVEVDAAPTVDLNQVLNETRNQY

SEQ ID NO: 4201 - protein, 36 aa, Artificial
  Consensus peptide
EVNTLRSPLGDRLNVEVDAAPTVDLNQVLNETRNQY

SEQ ID NO: 4202 - protein, 36 aa, Artificial
  Consensus peptide
EVNTLRCQLGDRLNVEVDTAPTVDLNQVLNETRNQY

SEQ ID NO: 4203 - protein, 36 aa, Artificial
  Consensus peptide
EVNTLRSQLGDRLNVEVDTAPTVDLNQVLNETRNQY

SEQ ID NO: 4204 - protein, 36 aa, Artificial
  Consensus peptide
EVNTLRCPLGDRLNVEVDTAPTVDLNQVLNETRNQY

SEQ ID NO: 4205 - protein, 36 aa, Artificial
  Consensus peptide
EVNTLRSPLGDRLNVEVDTAPTVDLNQVLNETRNQY

SEQ ID NO: 4206 - protein, 36 aa, Artificial
  Consensus peptide
EVNTLRCQLGDRLNVEVDAAPTVDLNRVLNETRNQY

SEQ ID NO: 4207 - protein, 36 aa, Artificial
  Consensus peptide
EVNTLRSQLGDRLNVEVDAAPTVDLNRVLNETRNQY

SEQ ID NO: 4208 - protein, 36 aa, Artificial
  Consensus peptide
EVNTLRCPLGDRLNVEVDAAPTVDLNRVLNETRNQY

SEQ ID NO: 4209 - protein, 36 aa, Artificial
  Consensus peptide
EVNTLRSPLGDRLNVEVDAAPTVDLNRVLNETRNQY

SEQ ID NO: 4210 - protein, 36 aa, Artificial
  Consensus peptide
EVNTLRCQLGDRLNVEVDTAPTVDLNRVLNETRNQY

SEQ ID NO: 4211 - protein, 36 aa, Artificial
  Consensus peptide
EVNTLRSQLGDRLNVEVDTAPTVDLNRVLNETRNQY

SEQ ID NO: 4212 - protein, 36 aa, Artificial
  Consensus peptide
EVNTLRCPLGDRLNVEVDTAPTVDLNRVLNETRNQY

SEQ ID NO: 4213 - protein, 36 aa, Artificial
  Consensus peptide
EVNTLRSPLGDRLNVEVDTAPTVDLNRVLNETRNQY

SEQ ID NO: 4214 - protein, 36 aa, Artificial
  Consensus peptide
VNTLRCQLGDRLNVEVDAAPTVDLNQVLNETRSQYE

SEQ ID NO: 4215 - protein, 36 aa, Artificial
  Consensus peptide
VNTLRSQLGDRLNVEVDAAPTVDLNQVLNETRSQYE

SEQ ID NO: 4216 - protein, 36 aa, Artificial
  Consensus peptide
VNTLRCPLGDRLNVEVDAAPTVDLNQVLNETRSQYE

SEQ ID NO: 4217 - protein, 36 aa, Artificial
  Consensus peptide
VNTLRSPLGDRLNVEVDAAPTVDLNQVLNETRSQYE

SEQ ID NO: 4218 - protein, 36 aa, Artificial
  Consensus peptide
VNTLRCQLGDRLNVEVDTAPTVDLNQVLNETRSQYE

SEQ ID NO: 4219 - protein, 36 aa, Artificial
  Consensus peptide
VNTLRSQLGDRLNVEVDTAPTVDLNQVLNETRSQYE

SEQ ID NO: 4220 - protein, 36 aa, Artificial
  Consensus peptide
VNTLRCPLGDRLNVEVDTAPTVDLNQVLNETRSQYE

SEQ ID NO: 4221 - protein, 36 aa, Artificial
  Consensus peptide
VNTLRSPLGDRLNVEVDTAPTVDLNQVLNETRSQYE

SEQ ID NO: 4222 - protein, 36 aa, Artificial
  Consensus peptide
VNTLRCQLGDRLNVEVDAAPTVDLNRVLNETRSQYE

SEQ ID NO: 4223 - protein, 36 aa, Artificial
  Consensus peptide
VNTLRSQLGDRLNVEVDAAPTVDLNRVLNETRSQYE

SEQ ID NO: 4224 - protein, 36 aa, Artificial
  Consensus peptide
VNTLRCPLGDRLNVEVDAAPTVDLNRVLNETRSQYE

SEQ ID NO: 4225 - protein, 36 aa, Artificial
  Consensus peptide
VNTLRSPLGDRLNVEVDAAPTVDLNRVLNETRSQYE

SEQ ID NO: 4226 - protein, 36 aa, Artificial
  Consensus peptide
VNTLRCQLGDRLNVEVDTAPTVDLNRVLNETRSQYE

SEQ ID NO: 4227 - protein, 36 aa, Artificial
  Consensus peptide
VNTLRSQLGDRLNVEVDTAPTVDLNRVLNETRSQYE

SEQ ID NO: 4228 - protein, 36 aa, Artificial
  Consensus peptide
VNTLRCPLGDRLNVEVDTAPTVDLNRVLNETRSQYE

SEQ ID NO: 4229 - protein, 36 aa, Artificial
  Consensus peptide
VNTLRSPLGDRLNVEVDTAPTVDLNRVLNETRSQYE

SEQ ID NO: 4230 - protein, 36 aa, Artificial
  Consensus peptide
VNTLRCQLGDRLNVEVDAAPTVDLNQVLNETRNQYE

SEQ ID NO: 4231 - protein, 36 aa, Artificial
  Consensus peptide
VNTLRSQLGDRLNVEVDAAPTVDLNQVLNETRNQYE

SEQ ID NO: 4232 - protein, 36 aa, Artificial
  Consensus peptide
VNTLRCPLGDRLNVEVDAAPTVDLNQVLNETRNQYE

SEQ ID NO: 4233 - protein, 36 aa, Artificial
  Consensus peptide
VNTLRSPLGDRLNVEVDAAPTVDLNQVLNETRNQYE

SEQ ID NO: 4234 - protein, 36 aa, Artificial
  Consensus peptide
VNTLRCQLGDRLNVEVDTAPTVDLNQVLNETRNQYE

SEQ ID NO: 4235 - protein, 36 aa, Artificial
  Consensus peptide
VNTLRSQLGDRLNVEVDTAPTVDLNQVLNETRNQYE

SEQ ID NO: 4236 - protein, 36 aa, Artificial
  Consensus peptide
VNTLRCPLGDRLNVEVDTAPTVDLNQVLNETRNQYE

SEQ ID NO: 4237 - protein, 36 aa, Artificial
  Consensus peptide
VNTLRSPLGDRLNVEVDTAPTVDLNQVLNETRNQYE

SEQ ID NO: 4238 - protein, 36 aa, Artificial
  Consensus peptide
VNTLRCQLGDRLNVEVDAAPTVDLNRVLNETRNQYE

SEQ ID NO: 4239 - protein, 36 aa, Artificial
  Consensus peptide
VNTLRSQLGDRLNVEVDAAPTVDLNRVLNETRNQYE

SEQ ID NO: 4240 - protein, 36 aa, Artificial
  Consensus peptide
VNTLRCPLGDRLNVEVDAAPTVDLNRVLNETRNQYE

SEQ ID NO: 4241 - protein, 36 aa, Artificial
  Consensus peptide
VNTLRSPLGDRLNVEVDAAPTVDLNRVLNETRNQYE

SEQ ID NO: 4242 - protein, 36 aa, Artificial
  Consensus peptide
VNTLRCQLGDRLNVEVDTAPTVDLNRVLNETRNQYE

SEQ ID NO: 4243 - protein, 36 aa, Artificial
  Consensus peptide
VNTLRSQLGDRLNVEVDTAPTVDLNRVLNETRNQYE

SEQ ID NO: 4244 - protein, 36 aa, Artificial
  Consensus peptide
VNTLRCPLGDRLNVEVDTAPTVDLNRVLNETRNQYE

SEQ ID NO: 4245 - protein, 36 aa, Artificial
  Consensus peptide
VNTLRSPLGDRLNVEVDTAPTVDLNRVLNETRNQYE

SEQ ID NO: 4246 - protein, 36 aa, Artificial
  Consensus peptide
NTLRCQLGDRLNVEVDAAPTVDLNQVLNETRSQYEA

SEQ ID NO: 4247 - protein, 36 aa, Artificial
  Consensus peptide
NTLRSQLGDRLNVEVDAAPTVDLNQVLNETRSQYEA

SEQ ID NO: 4248 - protein, 36 aa, Artificial
  Consensus peptide
NTLRCPLGDRLNVEVDAAPTVDLNQVLNETRSQYEA

SEQ ID NO: 4249 - protein, 36 aa, Artificial
  Consensus peptide
NTLRSPLGDRLNVEVDAAPTVDLNQVLNETRSQYEA

SEQ ID NO: 4250 - protein, 36 aa, Artificial
  Consensus peptide
NTLRCQLGDRLNVEVDTAPTVDLNQVLNETRSQYEA

SEQ ID NO: 4251 - protein, 36 aa, Artificial
  Consensus peptide
NTLRSQLGDRLNVEVDTAPTVDLNQVLNETRSQYEA

SEQ ID NO: 4252 - protein, 36 aa, Artificial
  Consensus peptide
NTLRCPLGDRLNVEVDTAPTVDLNQVLNETRSQYEA

SEQ ID NO: 4253 - protein, 36 aa, Artificial
  Consensus peptide
NTLRSPLGDRLNVEVDTAPTVDLNQVLNETRSQYEA

SEQ ID NO: 4254 - protein, 36 aa, Artificial
  Consensus peptide
NTLRCQLGDRLNVEVDAAPTVDLNRVLNETRSQYEA

SEQ ID NO: 4255 - protein, 36 aa, Artificial
  Consensus peptide
NTLRSQLGDRLNVEVDAAPTVDLNRVLNETRSQYEA

SEQ ID NO: 4256 - protein, 36 aa, Artificial
  Consensus peptide
NTLRCPLGDRLNVEVDAAPTVDLNRVLNETRSQYEA

SEQ ID NO: 4257 - protein, 36 aa, Artificial
  Consensus peptide
NTLRSPLGDRLNVEVDAAPTVDLNRVLNETRSQYEA

SEQ ID NO: 4258 - protein, 36 aa, Artificial
  Consensus peptide
NTLRCQLGDRLNVEVDTAPTVDLNRVLNETRSQYEA

SEQ ID NO: 4259 - protein, 36 aa, Artificial
  Consensus peptide
NTLRSQLGDRLNVEVDTAPTVDLNRVLNETRSQYEA

SEQ ID NO: 4260 - protein, 36 aa, Artificial
  Consensus peptide
NTLRCPLGDRLNVEVDTAPTVDLNRVLNETRSQYEA

SEQ ID NO: 4261 - protein, 36 aa, Artificial
  Consensus peptide
NTLRSPLGDRLNVEVDTAPTVDLNRVLNETRSQYEA

SEQ ID NO: 4262 - protein, 36 aa, Artificial
  Consensus peptide
NTLRCQLGDRLNVEVDAAPTVDLNQVLNETRNQYEA

SEQ ID NO: 4263 - protein, 36 aa, Artificial
  Consensus peptide
NTLRSQLGDRLNVEVDAAPTVDLNQVLNETRNQYEA

SEQ ID NO: 4264 - protein, 36 aa, Artificial
  Consensus peptide
NTLRCPLGDRLNVEVDAAPTVDLNQVLNETRNQYEA

SEQ ID NO: 4265 - protein, 36 aa, Artificial
  Consensus peptide
NTLRSPLGDRLNVEVDAAPTVDLNQVLNETRNQYEA

SEQ ID NO: 4266 - protein, 36 aa, Artificial
  Consensus peptide
NTLRCQLGDRLNVEVDTAPTVDLNQVLNETRNQYEA

SEQ ID NO: 4267 - protein, 36 aa, Artificial
  Consensus peptide
NTLRSQLGDRLNVEVDTAPTVDLNQVLNETRNQYEA

SEQ ID NO: 4268 - protein, 36 aa, Artificial
  Consensus peptide
NTLRCPLGDRLNVEVDTAPTVDLNQVLNETRNQYEA

SEQ ID NO: 4269 - protein, 36 aa, Artificial
  Consensus peptide
NTLRSPLGDRLNVEVDTAPTVDLNQVLNETRNQYEA

SEQ ID NO: 4270 - protein, 36 aa, Artificial
  Consensus peptide
NTLRCQLGDRLNVEVDAAPTVDLNRVLNETRNQYEA

SEQ ID NO: 4271 - protein, 36 aa, Artificial
  Consensus peptide
NTLRSQLGDRLNVEVDAAPTVDLNRVLNETRNQYEA

SEQ ID NO: 4272 - protein, 36 aa, Artificial
  Consensus peptide
NTLRCPLGDRLNVEVDAAPTVDLNRVLNETRNQYEA

SEQ ID NO: 4273 - protein, 36 aa, Artificial
  Consensus peptide
NTLRSPLGDRLNVEVDAAPTVDLNRVLNETRNQYEA

SEQ ID NO: 4274 - protein, 36 aa, Artificial
  Consensus peptide
NTLRCQLGDRLNVEVDTAPTVDLNRVLNETRNQYEA

SEQ ID NO: 4275 - protein, 36 aa, Artificial
  Consensus peptide
NTLRSQLGDRLNVEVDTAPTVDLNRVLNETRNQYEA

SEQ ID NO: 4276 - protein, 36 aa, Artificial
  Consensus peptide
NTLRCPLGDRLNVEVDTAPTVDLNRVLNETRNQYEA

SEQ ID NO: 4277 - protein, 36 aa, Artificial
  Consensus peptide
NTLRSPLGDRLNVEVDTAPTVDLNRVLNETRNQYEA

SEQ ID NO: 4278 - protein, 36 aa, Artificial
  Consensus peptide
TLRCQLGDRLNVEVDAAPTVDLNQVLNETRSQYEAL

SEQ ID NO: 4279 - protein, 36 aa, Artificial
  Consensus peptide
TLRSQLGDRLNVEVDAAPTVDLNQVLNETRSQYEAL

SEQ ID NO: 4280 - protein, 36 aa, Artificial
  Consensus peptide
TLRCPLGDRLNVEVDAAPTVDLNQVLNETRSQYEAL

SEQ ID NO: 4281 - protein, 36 aa, Artificial
  Consensus peptide
TLRSPLGDRLNVEVDAAPTVDLNQVLNETRSQYEAL

SEQ ID NO: 4282 - protein, 36 aa, Artificial
  Consensus peptide
TLRCQLGDRLNVEVDTAPTVDLNQVLNETRSQYEAL

SEQ ID NO: 4283 - protein, 36 aa, Artificial
  Consensus peptide
TLRSQLGDRLNVEVDTAPTVDLNQVLNETRSQYEAL

SEQ ID NO: 4284 - protein, 36 aa, Artificial
  Consensus peptide
TLRCPLGDRLNVEVDTAPTVDLNQVLNETRSQYEAL

SEQ ID NO: 4285 - protein, 36 aa, Artificial
  Consensus peptide
TLRSPLGDRLNVEVDTAPTVDLNQVLNETRSQYEAL

SEQ ID NO: 4286 - protein, 36 aa, Artificial
  Consensus peptide
TLRCQLGDRLNVEVDAAPTVDLNRVLNETRSQYEAL

SEQ ID NO: 4287 - protein, 36 aa, Artificial
  Consensus peptide
TLRSQLGDRLNVEVDAAPTVDLNRVLNETRSQYEAL

SEQ ID NO: 4288 - protein, 36 aa, Artificial
  Consensus peptide
TLRCPLGDRLNVEVDAAPTVDLNRVLNETRSQYEAL

SEQ ID NO: 4289 - protein, 36 aa, Artificial
  Consensus peptide
TLRSPLGDRLNVEVDAAPTVDLNRVLNETRSQYEAL

SEQ ID NO: 4290 - protein, 36 aa, Artificial
  Consensus peptide
TLRCQLGDRLNVEVDTAPTVDLNRVLNETRSQYEAL

SEQ ID NO: 4291 - protein, 36 aa, Artificial
  Consensus peptide
TLRSQLGDRLNVEVDTAPTVDLNRVLNETRSQYEAL

SEQ ID NO: 4292 - protein, 36 aa, Artificial
  Consensus peptide
TLRCPLGDRLNVEVDTAPTVDLNRVLNETRSQYEAL

SEQ ID NO: 4293 - protein, 36 aa, Artificial
  Consensus peptide
TLRSPLGDRLNVEVDTAPTVDLNRVLNETRSQYEAL

SEQ ID NO: 4294 - protein, 36 aa, Artificial
  Consensus peptide
TLRCQLGDRLNVEVDAAPTVDLNQVLNETRNQYEAL

SEQ ID NO: 4295 - protein, 36 aa, Artificial
  Consensus peptide
TLRSQLGDRLNVEVDAAPTVDLNQVLNETRNQYEAL

SEQ ID NO: 4296 - protein, 36 aa, Artificial
  Consensus peptide
TLRCPLGDRLNVEVDAAPTVDLNQVLNETRNQYEAL

SEQ ID NO: 4297 - protein, 36 aa, Artificial
  Consensus peptide
TLRSPLGDRLNVEVDAAPTVDLNQVLNETRNQYEAL

SEQ ID NO: 4298 - protein, 36 aa, Artificial
  Consensus peptide
TLRCQLGDRLNVEVDTAPTVDLNQVLNETRNQYEAL

SEQ ID NO: 4299 - protein, 36 aa, Artificial
  Consensus peptide
TLRSQLGDRLNVEVDTAPTVDLNQVLNETRNQYEAL

SEQ ID NO: 4300 - protein, 36 aa, Artificial
  Consensus peptide
TLRCPLGDRLNVEVDTAPTVDLNQVLNETRNQYEAL

SEQ ID NO: 4301 - protein, 36 aa, Artificial
  Consensus peptide
TLRSPLGDRLNVEVDTAPTVDLNQVLNETRNQYEAL

SEQ ID NO: 4302 - protein, 36 aa, Artificial
  Consensus peptide
TLRCQLGDRLNVEVDAAPTVDLNRVLNETRNQYEAL

SEQ ID NO: 4303 - protein, 36 aa, Artificial
  Consensus peptide
TLRSQLGDRLNVEVDAAPTVDLNRVLNETRNQYEAL

SEQ ID NO: 4304 - protein, 36 aa, Artificial
  Consensus peptide
TLRCPLGDRLNVEVDAAPTVDLNRVLNETRNQYEAL

SEQ ID NO: 4305 - protein, 36 aa, Artificial
  Consensus peptide
TLRSPLGDRLNVEVDAAPTVDLNRVLNETRNQYEAL

SEQ ID NO: 4306 - protein, 36 aa, Artificial
  Consensus peptide
TLRCQLGDRLNVEVDTAPTVDLNRVLNETRNQYEAL

SEQ ID NO: 4307 - protein, 36 aa, Artificial
  Consensus peptide
TLRSQLGDRLNVEVDTAPTVDLNRVLNETRNQYEAL

SEQ ID NO: 4308 - protein, 36 aa, Artificial
  Consensus peptide
TLRCPLGDRLNVEVDTAPTVDLNRVLNETRNQYEAL

SEQ ID NO: 4309 - protein, 36 aa, Artificial
  Consensus peptide
TLRSPLGDRLNVEVDTAPTVDLNRVLNETRNQYEAL

SEQ ID NO: 4310 - protein, 37 aa, Artificial
  Consensus peptide
EVNTLRCQLGDRLNVEVDAAPTVDLNQVLNETRSQYE

SEQ ID NO: 4311 - protein, 37 aa, Artificial
  Consensus peptide
EVNTLRSQLGDRLNVEVDAAPTVDLNQVLNETRSQYE

SEQ ID NO: 4312 - protein, 37 aa, Artificial
  Consensus peptide
EVNTLRCPLGDRLNVEVDAAPTVDLNQVLNETRSQYE

SEQ ID NO: 4313 - protein, 37 aa, Artificial
  Consensus peptide
EVNTLRSPLGDRLNVEVDAAPTVDLNQVLNETRSQYE

SEQ ID NO: 4314 - protein, 37 aa, Artificial
  Consensus peptide
EVNTLRCQLGDRLNVEVDTAPTVDLNQVLNETRSQYE

SEQ ID NO: 4315 - protein, 37 aa, Artificial
  Consensus peptide
EVNTLRSQLGDRLNVEVDTAPTVDLNQVLNETRSQYE

SEQ ID NO: 4316 - protein, 37 aa, Artificial
  Consensus peptide
EVNTLRCPLGDRLNVEVDTAPTVDLNQVLNETRSQYE

SEQ ID NO: 4317 - protein, 37 aa, Artificial
  Consensus peptide
EVNTLRSPLGDRLNVEVDTAPTVDLNQVLNETRSQYE

SEQ ID NO: 4318 - protein, 37 aa, Artificial
  Consensus peptide
EVNTLRCQLGDRLNVEVDAAPTVDLNRVLNETRSQYE

SEQ ID NO: 4319 - protein, 37 aa, Artificial
  Consensus peptide
EVNTLRSQLGDRLNVEVDAAPTVDLNRVLNETRSQYE

SEQ ID NO: 4320 - protein, 37 aa, Artificial
  Consensus peptide
EVNTLRCPLGDRLNVEVDAAPTVDLNRVLNETRSQYE

SEQ ID NO: 4321 - protein, 37 aa, Artificial
  Consensus peptide
EVNTLRSPLGDRLNVEVDAAPTVDLNRVLNETRSQYE

SEQ ID NO: 4322 - protein, 37 aa, Artificial
  Consensus peptide
EVNTLRCQLGDRLNVEVDTAPTVDLNRVLNETRSQYE

SEQ ID NO: 4323 - protein, 37 aa, Artificial
  Consensus peptide
EVNTLRSQLGDRLNVEVDTAPTVDLNRVLNETRSQYE

SEQ ID NO: 4324 - protein, 37 aa, Artificial
  Consensus peptide
EVNTLRCPLGDRLNVEVDTAPTVDLNRVLNETRSQYE

SEQ ID NO: 4325 - protein, 37 aa, Artificial
  Consensus peptide
EVNTLRSPLGDRLNVEVDTAPTVDLNRVLNETRSQYE

SEQ ID NO: 4326 - protein, 37 aa, Artificial
  Consensus peptide
EVNTLRCQLGDRLNVEVDAAPTVDLNQVLNETRNQYE

SEQ ID NO: 4327 - protein, 37 aa, Artificial
  Consensus peptide
EVNTLRSQLGDRLNVEVDAAPTVDLNQVLNETRNQYE

SEQ ID NO: 4328 - protein, 37 aa, Artificial
  Consensus peptide
EVNTLRCPLGDRLNVEVDAAPTVDLNQVLNETRNQYE

SEQ ID NO: 4329 - protein, 37 aa, Artificial
  Consensus peptide
EVNTLRSPLGDRLNVEVDAAPTVDLNQVLNETRNQYE

SEQ ID NO: 4330 - protein, 37 aa, Artificial
  Consensus peptide
EVNTLRCQLGDRLNVEVDTAPTVDLNQVLNETRNQYE

SEQ ID NO: 4331 - protein, 37 aa, Artificial
  Consensus peptide
EVNTLRSQLGDRLNVEVDTAPTVDLNQVLNETRNQYE

SEQ ID NO: 4332 - protein, 37 aa, Artificial
  Consensus peptide
EVNTLRCPLGDRLNVEVDTAPTVDLNQVLNETRNQYE

SEQ ID NO: 4333 - protein, 37 aa, Artificial
  Consensus peptide
EVNTLRSPLGDRLNVEVDTAPTVDLNQVLNETRNQYE

SEQ ID NO: 4334 - protein, 37 aa, Artificial
  Consensus peptide
EVNTLRCQLGDRLNVEVDAAPTVDLNRVLNETRNQYE

SEQ ID NO: 4335 - protein, 37 aa, Artificial
  Consensus peptide
EVNTLRSQLGDRLNVEVDAAPTVDLNRVLNETRNQYE

SEQ ID NO: 4336 - protein, 37 aa, Artificial
  Consensus peptide
EVNTLRCPLGDRLNVEVDAAPTVDLNRVLNETRNQYE

SEQ ID NO: 4337 - protein, 37 aa, Artificial
  Consensus peptide
EVNTLRSPLGDRLNVEVDAAPTVDLNRVLNETRNQYE

SEQ ID NO: 4338 - protein, 37 aa, Artificial
  Consensus peptide
EVNTLRCQLGDRLNVEVDTAPTVDLNRVLNETRNQYE

SEQ ID NO: 4339 - protein, 37 aa, Artificial
  Consensus peptide
EVNTLRSQLGDRLNVEVDTAPTVDLNRVLNETRNQYE

SEQ ID NO: 4340 - protein, 37 aa, Artificial
  Consensus peptide
EVNTLRCPLGDRLNVEVDTAPTVDLNRVLNETRNQYE

SEQ ID NO: 4341 - protein, 37 aa, Artificial
  Consensus peptide
EVNTLRSPLGDRLNVEVDTAPTVDLNRVLNETRNQYE

SEQ ID NO: 4342 - protein, 37 aa, Artificial
  Consensus peptide
VNTLRCQLGDRLNVEVDAAPTVDLNQVLNETRSQYEA

SEQ ID NO: 4343 - protein, 37 aa, Artificial
  Consensus peptide
VNTLRSQLGDRLNVEVDAAPTVDLNQVLNETRSQYEA

SEQ ID NO: 4344 - protein, 37 aa, Artificial
  Consensus peptide
VNTLRCPLGDRLNVEVDAAPTVDLNQVLNETRSQYEA

SEQ ID NO: 4345 - protein, 37 aa, Artificial
  Consensus peptide
VNTLRSPLGDRLNVEVDAAPTVDLNQVLNETRSQYEA

SEQ ID NO: 4346 - protein, 37 aa, Artificial
  Consensus peptide
VNTLRCQLGDRLNVEVDTAPTVDLNQVLNETRSQYEA

SEQ ID NO: 4347 - protein, 37 aa, Artificial
  Consensus peptide
VNTLRSQLGDRLNVEVDTAPTVDLNQVLNETRSQYEA

SEQ ID NO: 4348 - protein, 37 aa, Artificial
  Consensus peptide
VNTLRCPLGDRLNVEVDTAPTVDLNQVLNETRSQYEA

SEQ ID NO: 4349 - protein, 37 aa, Artificial
  Consensus peptide
VNTLRSPLGDRLNVEVDTAPTVDLNQVLNETRSQYEA

SEQ ID NO: 4350 - protein, 37 aa, Artificial
  Consensus peptide
VNTLRCQLGDRLNVEVDAAPTVDLNRVLNETRSQYEA

SEQ ID NO: 4351 - protein, 37 aa, Artificial
  Consensus peptide
VNTLRSQLGDRLNVEVDAAPTVDLNRVLNETRSQYEA

SEQ ID NO: 4352 - protein, 37 aa, Artificial
  Consensus peptide
VNTLRCPLGDRLNVEVDAAPTVDLNRVLNETRSQYEA

SEQ ID NO: 4353 - protein, 37 aa, Artificial
  Consensus peptide
VNTLRSPLGDRLNVEVDAAPTVDLNRVLNETRSQYEA

SEQ ID NO: 4354 - protein, 37 aa, Artificial
  Consensus peptide
VNTLRCQLGDRLNVEVDTAPTVDLNRVLNETRSQYEA

SEQ ID NO: 4355 - protein, 37 aa, Artificial
  Consensus peptide
VNTLRSQLGDRLNVEVDTAPTVDLNRVLNETRSQYEA

SEQ ID NO: 4356 - protein, 37 aa, Artificial
  Consensus peptide
VNTLRCPLGDRLNVEVDTAPTVDLNRVLNETRSQYEA

SEQ ID NO: 4357 - protein, 37 aa, Artificial
  Consensus peptide
VNTLRSPLGDRLNVEVDTAPTVDLNRVLNETRSQYEA

SEQ ID NO: 4358 - protein, 37 aa, Artificial
  Consensus peptide
VNTLRCQLGDRLNVEVDAAPTVDLNQVLNETRNQYEA

SEQ ID NO: 4359 - protein, 37 aa, Artificial
  Consensus peptide
VNTLRSQLGDRLNVEVDAAPTVDLNQVLNETRNQYEA

SEQ ID NO: 4360 - protein, 37 aa, Artificial
  Consensus peptide
VNTLRCPLGDRLNVEVDAAPTVDLNQVLNETRNQYEA

SEQ ID NO: 4361 - protein, 37 aa, Artificial
  Consensus peptide
VNTLRSPLGDRLNVEVDAAPTVDLNQVLNETRNQYEA

SEQ ID NO: 4362 - protein, 37 aa, Artificial
  Consensus peptide
VNTLRCQLGDRLNVEVDTAPTVDLNQVLNETRNQYEA

SEQ ID NO: 4363 - protein, 37 aa, Artificial
  Consensus peptide
VNTLRSQLGDRLNVEVDTAPTVDLNQVLNETRNQYEA

SEQ ID NO: 4364 - protein, 37 aa, Artificial
  Consensus peptide
VNTLRCPLGDRLNVEVDTAPTVDLNQVLNETRNQYEA

SEQ ID NO: 4365 - protein, 37 aa, Artificial
  Consensus peptide
VNTLRSPLGDRLNVEVDTAPTVDLNQVLNETRNQYEA

SEQ ID NO: 4366 - protein, 37 aa, Artificial
  Consensus peptide
VNTLRCQLGDRLNVEVDAAPTVDLNRVLNETRNQYEA

SEQ ID NO: 4367 - protein, 37 aa, Artificial
  Consensus peptide
VNTLRSQLGDRLNVEVDAAPTVDLNRVLNETRNQYEA

SEQ ID NO: 4368 - protein, 37 aa, Artificial
  Consensus peptide
VNTLRCPLGDRLNVEVDAAPTVDLNRVLNETRNQYEA

SEQ ID NO: 4369 - protein, 37 aa, Artificial
  Consensus peptide
VNTLRSPLGDRLNVEVDAAPTVDLNRVLNETRNQYEA

SEQ ID NO: 4370 - protein, 37 aa, Artificial
  Consensus peptide
VNTLRCQLGDRLNVEVDTAPTVDLNRVLNETRNQYEA

SEQ ID NO: 4371 - protein, 37 aa, Artificial
  Consensus peptide
VNTLRSQLGDRLNVEVDTAPTVDLNRVLNETRNQYEA

SEQ ID NO: 4372 - protein, 37 aa, Artificial
  Consensus peptide
VNTLRCPLGDRLNVEVDTAPTVDLNRVLNETRNQYEA

SEQ ID NO: 4373 - protein, 37 aa, Artificial
  Consensus peptide
VNTLRSPLGDRLNVEVDTAPTVDLNRVLNETRNQYEA

SEQ ID NO: 4374 - protein, 37 aa, Artificial
  Consensus peptide
NTLRCQLGDRLNVEVDAAPTVDLNQVLNETRSQYEAL

SEQ ID NO: 4375 - protein, 37 aa, Artificial
  Consensus peptide
NTLRSQLGDRLNVEVDAAPTVDLNQVLNETRSQYEAL

SEQ ID NO: 4376 - protein, 37 aa, Artificial
  Consensus peptide
NTLRCPLGDRLNVEVDAAPTVDLNQVLNETRSQYEAL

SEQ ID NO: 4377 - protein, 37 aa, Artificial
  Consensus peptide
NTLRSPLGDRLNVEVDAAPTVDLNQVLNETRSQYEAL

SEQ ID NO: 4378 - protein, 37 aa, Artificial
  Consensus peptide
NTLRCQLGDRLNVEVDTAPTVDLNQVLNETRSQYEAL

SEQ ID NO: 4379 - protein, 37 aa, Artificial
  Consensus peptide
NTLRSQLGDRLNVEVDTAPTVDLNQVLNETRSQYEAL

SEQ ID NO: 4380 - protein, 37 aa, Artificial
  Consensus peptide
NTLRCPLGDRLNVEVDTAPTVDLNQVLNETRSQYEAL

SEQ ID NO: 4381 - protein, 37 aa, Artificial
  Consensus peptide
NTLRSPLGDRLNVEVDTAPTVDLNQVLNETRSQYEAL

SEQ ID NO: 4382 - protein, 37 aa, Artificial
  Consensus peptide
NTLRCQLGDRLNVEVDAAPTVDLNRVLNETRSQYEAL

SEQ ID NO: 4383 - protein, 37 aa, Artificial
  Consensus peptide
NTLRSQLGDRLNVEVDAAPTVDLNRVLNETRSQYEAL

SEQ ID NO: 4384 - protein, 37 aa, Artificial
  Consensus peptide
NTLRCPLGDRLNVEVDAAPTVDLNRVLNETRSQYEAL

SEQ ID NO: 4385 - protein, 37 aa, Artificial
  Consensus peptide
NTLRSPLGDRLNVEVDAAPTVDLNRVLNETRSQYEAL

SEQ ID NO: 4386 - protein, 37 aa, Artificial
  Consensus peptide
NTLRCQLGDRLNVEVDTAPTVDLNRVLNETRSQYEAL

SEQ ID NO: 4387 - protein, 37 aa, Artificial
  Consensus peptide
NTLRSQLGDRLNVEVDTAPTVDLNRVLNETRSQYEAL

SEQ ID NO: 4388 - protein, 37 aa, Artificial
  Consensus peptide
NTLRCPLGDRLNVEVDTAPTVDLNRVLNETRSQYEAL

SEQ ID NO: 4389 - protein, 37 aa, Artificial
  Consensus peptide
NTLRSPLGDRLNVEVDTAPTVDLNRVLNETRSQYEAL

SEQ ID NO: 4390 - protein, 37 aa, Artificial
  Consensus peptide
NTLRCQLGDRLNVEVDAAPTVDLNQVLNETRNQYEAL

SEQ ID NO: 4391 - protein, 37 aa, Artificial
  Consensus peptide
NTLRSQLGDRLNVEVDAAPTVDLNQVLNETRNQYEAL

SEQ ID NO: 4392 - protein, 37 aa, Artificial
  Consensus peptide
NTLRCPLGDRLNVEVDAAPTVDLNQVLNETRNQYEAL

SEQ ID NO: 4393 - protein, 37 aa, Artificial
  Consensus peptide
NTLRSPLGDRLNVEVDAAPTVDLNQVLNETRNQYEAL

SEQ ID NO: 4394 - protein, 37 aa, Artificial
  Consensus peptide
NTLRCQLGDRLNVEVDTAPTVDLNQVLNETRNQYEAL

SEQ ID NO: 4395 - protein, 37 aa, Artificial
  Consensus peptide
NTLRSQLGDRLNVEVDTAPTVDLNQVLNETRNQYEAL

SEQ ID NO: 4396 - protein, 37 aa, Artificial
  Consensus peptide
NTLRCPLGDRLNVEVDTAPTVDLNQVLNETRNQYEAL

SEQ ID NO: 4397 - protein, 37 aa, Artificial
  Consensus peptide
NTLRSPLGDRLNVEVDTAPTVDLNQVLNETRNQYEAL

SEQ ID NO: 4398 - protein, 37 aa, Artificial
  Consensus peptide
NTLRCQLGDRLNVEVDAAPTVDLNRVLNETRNQYEAL

SEQ ID NO: 4399 - protein, 37 aa, Artificial
  Consensus peptide
NTLRSQLGDRLNVEVDAAPTVDLNRVLNETRNQYEAL

SEQ ID NO: 4400 - protein, 37 aa, Artificial
  Consensus peptide
NTLRCPLGDRLNVEVDAAPTVDLNRVLNETRNQYEAL

SEQ ID NO: 4401 - protein, 37 aa, Artificial
  Consensus peptide
NTLRSPLGDRLNVEVDAAPTVDLNRVLNETRNQYEAL

SEQ ID NO: 4402 - protein, 37 aa, Artificial
  Consensus peptide
NTLRCQLGDRLNVEVDTAPTVDLNRVLNETRNQYEAL

SEQ ID NO: 4403 - protein, 37 aa, Artificial
  Consensus peptide
NTLRSQLGDRLNVEVDTAPTVDLNRVLNETRNQYEAL

SEQ ID NO: 4404 - protein, 37 aa, Artificial
  Consensus peptide
NTLRCPLGDRLNVEVDTAPTVDLNRVLNETRNQYEAL

SEQ ID NO: 4405 - protein, 37 aa, Artificial
  Consensus peptide
NTLRSPLGDRLNVEVDTAPTVDLNRVLNETRNQYEAL

SEQ ID NO: 4406 - protein, 38 aa, Artificial
  Consensus peptide
EVNTLRCQLGDRLNVEVDAAPTVDLNQVLNETRSQYEA

SEQ ID NO: 4407 - protein, 38 aa, Artificial
  Consensus peptide
EVNTLRSQLGDRLNVEVDAAPTVDLNQVLNETRSQYEA

SEQ ID NO: 4408 - protein, 38 aa, Artificial
  Consensus peptide
EVNTLRCPLGDRLNVEVDAAPTVDLNQVLNETRSQYEA

SEQ ID NO: 4409 - protein, 38 aa, Artificial
  Consensus peptide
EVNTLRSPLGDRLNVEVDAAPTVDLNQVLNETRSQYEA

SEQ ID NO: 4410 - protein, 38 aa, Artificial
  Consensus peptide
EVNTLRCQLGDRLNVEVDTAPTVDLNQVLNETRSQYEA

SEQ ID NO: 4411 - protein, 38 aa, Artificial
  Consensus peptide
EVNTLRSQLGDRLNVEVDTAPTVDLNQVLNETRSQYEA

SEQ ID NO: 4412 - protein, 38 aa, Artificial
  Consensus peptide
EVNTLRCPLGDRLNVEVDTAPTVDLNQVLNETRSQYEA

SEQ ID NO: 4413 - protein, 38 aa, Artificial
  Consensus peptide
EVNTLRSPLGDRLNVEVDTAPTVDLNQVLNETRSQYEA

SEQ ID NO: 4414 - protein, 38 aa, Artificial
  Consensus peptide
EVNTLRCQLGDRLNVEVDAAPTVDLNRVLNETRSQYEA

SEQ ID NO: 4415 - protein, 38 aa, Artificial
  Consensus peptide
EVNTLRSQLGDRLNVEVDAAPTVDLNRVLNETRSQYEA

SEQ ID NO: 4416 - protein, 38 aa, Artificial
  Consensus peptide
EVNTLRCPLGDRLNVEVDAAPTVDLNRVLNETRSQYEA

SEQ ID NO: 4417 - protein, 38 aa, Artificial
  Consensus peptide
EVNTLRSPLGDRLNVEVDAAPTVDLNRVLNETRSQYEA

SEQ ID NO: 4418 - protein, 38 aa, Artificial
  Consensus peptide
EVNTLRCQLGDRLNVEVDTAPTVDLNRVLNETRSQYEA

SEQ ID NO: 4419 - protein, 38 aa, Artificial
  Consensus peptide
EVNTLRSQLGDRLNVEVDTAPTVDLNRVLNETRSQYEA

SEQ ID NO: 4420 - protein, 38 aa, Artificial
  Consensus peptide
EVNTLRCPLGDRLNVEVDTAPTVDLNRVLNETRSQYEA

SEQ ID NO: 4421 - protein, 38 aa, Artificial
  Consensus peptide
EVNTLRSPLGDRLNVEVDTAPTVDLNRVLNETRSQYEA

SEQ ID NO: 4422 - protein, 38 aa, Artificial
  Consensus peptide
EVNTLRCQLGDRLNVEVDAAPTVDLNQVLNETRNQYEA

SEQ ID NO: 4423 - protein, 38 aa, Artificial
  Consensus peptide
EVNTLRSQLGDRLNVEVDAAPTVDLNQVLNETRNQYEA

SEQ ID NO: 4424 - protein, 38 aa, Artificial
  Consensus peptide
EVNTLRCPLGDRLNVEVDAAPTVDLNQVLNETRNQYEA

SEQ ID NO: 4425 - protein, 38 aa, Artificial
  Consensus peptide
EVNTLRSPLGDRLNVEVDAAPTVDLNQVLNETRNQYEA

SEQ ID NO: 4426 - protein, 38 aa, Artificial
  Consensus peptide
EVNTLRCQLGDRLNVEVDTAPTVDLNQVLNETRNQYEA

SEQ ID NO: 4427 - protein, 38 aa, Artificial
  Consensus peptide
EVNTLRSQLGDRLNVEVDTAPTVDLNQVLNETRNQYEA

SEQ ID NO: 4428 - protein, 38 aa, Artificial
  Consensus peptide
EVNTLRCPLGDRLNVEVDTAPTVDLNQVLNETRNQYEA

SEQ ID NO: 4429 - protein, 38 aa, Artificial
  Consensus peptide
EVNTLRSPLGDRLNVEVDTAPTVDLNQVLNETRNQYEA

SEQ ID NO: 4430 - protein, 38 aa, Artificial
  Consensus peptide
EVNTLRCQLGDRLNVEVDAAPTVDLNRVLNETRNQYEA

SEQ ID NO: 4431 - protein, 38 aa, Artificial
  Consensus peptide
EVNTLRSQLGDRLNVEVDAAPTVDLNRVLNETRNQYEA

SEQ ID NO: 4432 - protein, 38 aa, Artificial
  Consensus peptide
EVNTLRCPLGDRLNVEVDAAPTVDLNRVLNETRNQYEA

SEQ ID NO: 4433 - protein, 38 aa, Artificial
  Consensus peptide
EVNTLRSPLGDRLNVEVDAAPTVDLNRVLNETRNQYEA

SEQ ID NO: 4434 - protein, 38 aa, Artificial
  Consensus peptide
EVNTLRCQLGDRLNVEVDTAPTVDLNRVLNETRNQYEA

SEQ ID NO: 4435 - protein, 38 aa, Artificial
  Consensus peptide
EVNTLRSQLGDRLNVEVDTAPTVDLNRVLNETRNQYEA

SEQ ID NO: 4436 - protein, 38 aa, Artificial
  Consensus peptide
EVNTLRCPLGDRLNVEVDTAPTVDLNRVLNETRNQYEA

SEQ ID NO: 4437 - protein, 38 aa, Artificial
  Consensus peptide
EVNTLRSPLGDRLNVEVDTAPTVDLNRVLNETRNQYEA

SEQ ID NO: 4438 - protein, 38 aa, Artificial
  Consensus peptide
VNTLRCQLGDRLNVEVDAAPTVDLNQVLNETRSQYEAL

SEQ ID NO: 4439 - protein, 38 aa, Artificial
  Consensus peptide
VNTLRSQLGDRLNVEVDAAPTVDLNQVLNETRSQYEAL

SEQ ID NO: 4440 - protein, 38 aa, Artificial
  Consensus peptide
VNTLRCPLGDRLNVEVDAAPTVDLNQVLNETRSQYEAL

SEQ ID NO: 4441 - protein, 38 aa, Artificial
  Consensus peptide
VNTLRSPLGDRLNVEVDAAPTVDLNQVLNETRSQYEAL

SEQ ID NO: 4442 - protein, 38 aa, Artificial
  Consensus peptide
VNTLRCQLGDRLNVEVDTAPTVDLNQVLNETRSQYEAL

SEQ ID NO: 4443 - protein, 38 aa, Artificial
  Consensus peptide
VNTLRSQLGDRLNVEVDTAPTVDLNQVLNETRSQYEAL

SEQ ID NO: 4444 - protein, 38 aa, Artificial
  Consensus peptide
VNTLRCPLGDRLNVEVDTAPTVDLNQVLNETRSQYEAL

SEQ ID NO: 4445 - protein, 38 aa, Artificial
  Consensus peptide
VNTLRSPLGDRLNVEVDTAPTVDLNQVLNETRSQYEAL

SEQ ID NO: 4446 - protein, 38 aa, Artificial
  Consensus peptide
VNTLRCQLGDRLNVEVDAAPTVDLNRVLNETRSQYEAL

SEQ ID NO: 4447 - protein, 38 aa, Artificial
  Consensus peptide
VNTLRSQLGDRLNVEVDAAPTVDLNRVLNETRSQYEAL

SEQ ID NO: 4448 - protein, 38 aa, Artificial; identical to SEQ ID NO: 11
  Consensus peptide

SEQ ID NO: 4449 - protein, 38 aa, Artificial
  Consensus peptide
VNTLRSPLGDRLNVEVDAAPTVDLNRVLNETRSQYEAL

SEQ ID NO: 4450 - protein, 38 aa, Artificial
  Consensus peptide
VNTLRCQLGDRLNVEVDTAPTVDLNRVLNETRSQYEAL

SEQ ID NO: 4451 - protein, 38 aa, Artificial
  Consensus peptide
VNTLRSQLGDRLNVEVDTAPTVDLNRVLNETRSQYEAL

SEQ ID NO: 4452 - protein, 38 aa, Artificial
  Consensus peptide
VNTLRCPLGDRLNVEVDTAPTVDLNRVLNETRSQYEAL

SEQ ID NO: 4453 - protein, 38 aa, Artificial
  Consensus peptide
VNTLRSPLGDRLNVEVDTAPTVDLNRVLNETRSQYEAL

SEQ ID NO: 4454 - protein, 38 aa, Artificial
  Consensus peptide
VNTLRCQLGDRLNVEVDAAPTVDLNQVLNETRNQYEAL

SEQ ID NO: 4455 - protein, 38 aa, Artificial
  Consensus peptide
VNTLRSQLGDRLNVEVDAAPTVDLNQVLNETRNQYEAL

SEQ ID NO: 4456 - protein, 38 aa, Artificial
  Consensus peptide
VNTLRCPLGDRLNVEVDAAPTVDLNQVLNETRNQYEAL

SEQ ID NO: 4457 - protein, 38 aa, Artificial
  Consensus peptide
VNTLRSPLGDRLNVEVDAAPTVDLNQVLNETRNQYEAL

SEQ ID NO: 4458 - protein, 38 aa, Artificial
  Consensus peptide
VNTLRCQLGDRLNVEVDTAPTVDLNQVLNETRNQYEAL

SEQ ID NO: 4459 - protein, 38 aa, Artificial
  Consensus peptide
VNTLRSQLGDRLNVEVDTAPTVDLNQVLNETRNQYEAL

SEQ ID NO: 4460 - protein, 38 aa, Artificial
  Consensus peptide
VNTLRCPLGDRLNVEVDTAPTVDLNQVLNETRNQYEAL

SEQ ID NO: 4461 - protein, 38 aa, Artificial
  Consensus peptide
VNTLRSPLGDRLNVEVDTAPTVDLNQVLNETRNQYEAL

SEQ ID NO: 4462 - protein, 38 aa, Artificial
  Consensus peptide
VNTLRCQLGDRLNVEVDAAPTVDLNRVLNETRNQYEAL

SEQ ID NO: 4463 - protein, 38 aa, Artificial
  Consensus peptide
VNTLRSQLGDRLNVEVDAAPTVDLNRVLNETRNQYEAL

SEQ ID NO: 4464 - protein, 38 aa, Artificial
  Consensus peptide
VNTLRCPLGDRLNVEVDAAPTVDLNRVLNETRNQYEAL

SEQ ID NO: 4465 - protein, 38 aa, Artificial
  Consensus peptide
VNTLRSPLGDRLNVEVDAAPTVDLNRVLNETRNQYEAL

SEQ ID NO: 4466 - protein, 38 aa, Artificial
  Consensus peptide
VNTLRCQLGDRLNVEVDTAPTVDLNRVLNETRNQYEAL

SEQ ID NO: 4467 - protein, 38 aa, Artificial
  Consensus peptide
VNTLRSQLGDRLNVEVDTAPTVDLNRVLNETRNQYEAL

SEQ ID NO: 4468 - protein, 38 aa, Artificial
  Consensus peptide
VNTLRCPLGDRLNVEVDTAPTVDLNRVLNETRNQYEAL

SEQ ID NO: 4469 - protein, 38 aa, Artificial
  Consensus peptide
VNTLRSPLGDRLNVEVDTAPTVDLNRVLNETRNQYEAL

The invention claimed is:

1. An isolated bioactive peptide of from 25-39 amino acids in length wherein the amino acid sequence of the peptide consists of from 25-39 contiguous amino acids of any of SEQ ID NOS:1-32.

2. An isolated peptide, of from 25-39 amino acids in length wherein the amino acid sequence of the peptide consists of from 25-39 contiguous amino acids of any of SEQ ID NOS:1-32 wherein the N-terminal α-amine group is acetylated.

3. An isolated peptide, of from 25-39 amino acids in length wherein the amino acid sequence of the peptide consists of from 25-39 contiguous amino acids of any of SEQ ID NOS:1-32 wherein the C-terminal α-carboxy group is a carboxamide.

4. A composition comprising a mixture of peptides including the isolated peptide of claim 1, and one or more peptides with one or more of the following amino acid sequences DLNQ, SEQ ID NO:71, SPLGD, SEQ ID NO:111, LGDRL, SEQ ID NO:114, LNVEV, SEQ ID NO:118, AAPTV, SEQ ID NO:128, TAPTV, SEQ ID NO:129, NTLRSP, SEQ ID NO:162, RLNVEV, SEQ ID NO:184, VEVDAA, SEQ ID NO:188, VDAAPT, SEQ ID NO:192, VDTAPT, SEQ ID NO:193, DTAPTV, SEQ ID NO:195, AAPTVD, SEQ ID NO:196, TAPTVD, SEQ ID NO:197, DLNRVL, SEQ ID NO:205, EVDAAPT, SEQ ID NO:263, VDTAPTV, SEQ ID NO:266, DAAPTVD, SEQ ID NO:267, or APTVDLN, SEQ ID NO:271, wherein the isolated peptide is free of covalent bonds to another protein or peptide.

5. A composition in the form of a powder, lotion, hydrogel, oil, emulsion, paste, polish or cream, wherein the composition comprises the isolated bioactive peptide of claim 1 in combination with a carrier.

6. A wound dressing comprising the isolated bioactive peptide of claim 1 non-covalently associated with the dressing.

7. The wound dressing of claim 6, wherein the wound dressing is a sheet comprising a keratin derived product.

8. The wound dressing of claim 6, further defined as an adhesive bandage.

9. A tissue engineering scaffold comprising the isolated peptide of claim 1, wherein the isolated peptide is contained in or non-covalently adhered to the tissue engineering scaffold.

10. The tissue engineering scaffold of claim 9, wherein the tissue engineering scaffold comprises an insoluble material at least a part of which is obtained from a keratin product.

11. A composition in the form of a hydrogel, wherein the isolated peptide of claim 1 is contained in or associated with the hydrogel.

12. The composition of claim 11 wherein the hydrogel comprises a keratin derived hydrogel.

13. A composition for topical application to skin of a human or animal subject, said composition comprising the isolated peptide of claim 1, contained in a lotion, gel, paste, cream, or aqueous solution.

14. The composition of claim 13, for topical application to damaged epithelial tissue.

15. The composition of claim 14, wherein the damaged epithelial tissue comprises a wound, a rash, diaper rash, a burn, a sunburn, a cut, an abrasion, a puncture, a sore, a bedsore, an ulcer, or wrinkled skin.

16. The composition of claim 13, wherein the isolated peptide concentration is from about 100 μg/ml to about $1 \times 10^{-6}$ μg/ml.

17. A formulation for cosmetic application to skin comprising the isolated peptide of claim 1, wherein the isolated peptide is contained in a carrier for cosmetic application to skin.

18. The formulation of claim 17, wherein the isolated peptide is contained in a moisturizer, a deodorant, an anti-aging/skin repair preparation, a cleanser, a toner, an eye care composition, a lip care composition, a fingernail care composition, a toenail care composition, a scalp care composition, a sun care composition, a hand care composition, or a body care composition.

19. The formulation of claim 17, wherein the isolated peptide is contained in an after-care product for a skin insult.

20. The formulation of claim 19, wherein the skin insult is a chemical peel, sunburn, depilatory irritation, razor-shaving nick, an abrasion, or scalp irritation from hair treatment.

21. The formulation of claim 17, wherein the isolated peptide is contained in a water based make up.

22. The formulation of claim 17, wherein the isolated peptide is contained in a hair care product.

23. The formulation of claim 22, wherein the product is a shampoo or hair conditioner.

24. A wound dressing comprising the isolated peptide of claim 1 contained in, or non-covalently adhered to a sheet, film or fabric dressing.

25. The wound dressing of claim 24, wherein the dressing comprises a keratin derivative.

26. The wound dressing of claim 24, wherein said wound dressing is an adhesive bandage.

27. The wound dressing of claim 24, wherein the dressing comprises wool or cotton fabric.

28. The wound dressing of claim 24, wherein the dressing is a woven keratin sheet.

29. The wound dressing of claim 24, wherein the dressing is a non-woven sheet or film comprising a water insoluble keratin.

30. The composition of claim 14, wherein the epithelial tissue is skin, nasal, oral, gastro-intestinal, anal, vaginal, ear, eye, lung, or urogenital epithelial tissue.

31. A cell growth scaffold comprising a keratin derived sheet material, porous material or hydrogel, and further comprising an isolated peptide of claim 1 contained in, or non-covalently adhered thereto.

32. The cell growth scaffold of claim 31, further defined as a spinal implant, a bone growth scaffold, a scaffold for growth of epithelial tissue, a bandage, a non-woven sheet or a woven sheet.

33. The cell growth scaffold of claim 32, wherein the non-woven or woven sheets comprise wool pads, woven keratin, keratin bonded to polymer sheets, or cross-linked keratin.

34. The cell growth scaffold of claim 31, further comprising an envelope containing the isolated peptide.

35. The cell growth scaffold of claim 31, comprising the isolated peptide bonded or non-covalently adhered to the surface of a metal, silicone or polymer implant.

36. An isolated peptide of from 25-39 amino acids in length wherein the peptide consists of from 25-39 contiguous amino acids of any of SEQ ID NOS:1-32, and wherein the peptide is obtained by a process comprising treating human or animal hair with an oxidizing agent to produce a mixture of water-soluble peptides, and isolating said peptides of 25-39 amino acids therefrom.

37. A composition comprising a mixture of peptides including the isolated peptide of claim 36, and one or more peptides with one or more of the following amino acid sequences: DLNQ, SEQ ID NO:71, SPLGD, SEQ ID NO:111, LGDR, SEQ ID NO:52, LGDRL, SEQ ID NO:114, LNVEV, SEQ ID NO:118, AAPTV, SEQ ID NO:128, TAPTV, SEQ ID NO:129, NTLRSP, SEQ ID NO:162, RLNVEV, SEQ ID NO:184, VEVDAA, SEQ ID NO:188, VDAAPT, SEQ ID NO:192, VDTAPT, SEQ ID NO:193, DTAPTV, SEQ ID NO:195, APTV, SEQ ID NO:67, AAPTVD, SEQ ID NO:196, TAPTVD, SEQ ID NO:197, DLNRVL, SEQ ID NO:205, EVDAAPT, SEQ ID NO:263, VDTAPTV, SEQ ID NO:266, DAAPTVD, SEQ ID NO:267, and APTVDLN, SEQ ID NO:271.

38. A composition comprising the isolated peptide of claim 1 contained in a pharmaceutically acceptable carrier.

\* \* \* \* \*